(12) United States Patent
Shen et al.

(10) Patent No.: US 10,407,742 B2
(45) Date of Patent: *Sep. 10, 2019

(54) INTEIN-MODIFIED ENZYMES, THEIR PRODUCTION AND INDUSTRIAL APPLICATIONS

(75) Inventors: Binzhang Shen, Jamaica Plain, MA (US); Gabor Lazar, Belmont, MA (US); Humberto de la Vega, Peabody, MA (US); Philip Lessard, Framingham, MA (US); R. Michael Raab, Arlington, MA (US); James Apgar, Somerville, MA (US)

(73) Assignee: Agrivida, Inc., Medford, MA (US)

( * ) Notice: Subject to any disclaimer, the term of this patent is extended or adjusted under 35 U.S.C. 154(b) by 852 days.

This patent is subject to a terminal disclaimer.

(21) Appl. No.: 13/508,156

(22) PCT Filed: Nov. 5, 2010

(86) PCT No.: PCT/US2010/055669
§ 371 (c)(1),
(2), (4) Date: Sep. 20, 2012

(87) PCT Pub. No.: WO2011/057101
PCT Pub. Date: May 12, 2011

(65) Prior Publication Data
US 2013/0007919 A1    Jan. 3, 2013

Related U.S. Application Data

(63) Continuation-in-part of application No. 12/590,444, filed on Nov. 6, 2009, now Pat. No. 8,420,387.

(51) Int. Cl.
*C12N 9/42*    (2006.01)
*C12N 9/24*    (2006.01)
*C12N 15/82*   (2006.01)

(52) U.S. Cl.
CPC ...... *C12Y 302/01004* (2013.01); *C12N 9/248* (2013.01); *C12N 9/2437* (2013.01); *C12N 15/8216* (2013.01); *C12N 15/8246* (2013.01); *C12N 15/8257* (2013.01); *C12Y 302/01008* (2013.01)

(58) Field of Classification Search
None
See application file for complete search history.

(56) References Cited

U.S. PATENT DOCUMENTS

| | | |
|---|---|---|
| 5,496,714 A | 3/1996 | Comb et al. |
| 5,654,184 A | 8/1997 | Curtiss et al. |
| 5,780,708 A | 7/1998 | Lundquist et al. |
| 5,834,247 A | 11/1998 | Comb et al. |
| 5,981,835 A | 11/1999 | Austin-Phillips et al. |
| 6,013,863 A | 1/2000 | Lundquist et al. |
| 6,022,846 A | 2/2000 | Van Ooijen et al. |
| 6,160,208 A | 12/2000 | Lundquist et al. |
| 6,395,966 B1 | 5/2002 | Mumm et al. |
| 6,531,316 B1 | 3/2003 | Lassner et al. |
| 6,800,792 B1 | 10/2004 | Howard et al. |
| 6,858,775 B1 | 2/2005 | Xu et al. |
| 7,102,057 B2 | 9/2006 | Lanahan et al. |
| 7,550,263 B2 | 6/2009 | Meade et al. |
| 7,709,697 B2 | 5/2010 | Raab |
| 8,420,387 B2* | 4/2013 | Shen et al. .................. 435/320.1 |
| 2002/0138878 A1 | 9/2002 | Sticklen et al. |
| 2003/0131376 A1 | 7/2003 | Okubara et al. |
| 2003/0159182 A1 | 8/2003 | Tackaberry et al. |
| 2003/0167533 A1 | 9/2003 | Yadav et al. |
| 2003/0233675 A1 | 12/2003 | Cao et al. |
| 2004/0096938 A1 | 5/2004 | Xu et al. |
| 2005/0125860 A1* | 6/2005 | Raab .................. C12N 15/8216 800/298 |
| 2005/0283850 A1 | 12/2005 | Snell |
| 2007/0192900 A1 | 8/2007 | Sticklen |
| 2008/0115243 A1 | 5/2008 | Raab et al. |
| 2009/0155238 A1 | 6/2009 | Weiner et al. |
| 2011/0053195 A1 | 3/2011 | Bauer et al. |

FOREIGN PATENT DOCUMENTS

| | | |
|---|---|---|
| EP | 0602899 | 6/1994 |
| WO | 97/01642 | 1/1997 |
| WO | 97/36995 A2 | 10/1997 |
| WO | 98/21348 | 5/1998 |
| WO | 00/36093 | 6/2000 |
| WO | 00/52155 | 9/2000 |
| WO | 00/71701 | 11/2000 |
| WO | 01/59091 | 8/2001 |
| WO | 03/050265 | 6/2003 |
| WO | 03/56904 | 7/2003 |
| WO | 2005/096804 A2 | 10/2005 |
| WO | 07/146944 | 12/2007 |
| WO | 2007146944 A2 | 12/2007 |

OTHER PUBLICATIONS

Xie et al, 2006, accession No. AM181054.*
Sakon et al, 1996, accession No. Gun1_ACIC1.*
Shen et al, 2012, Nat. Biotech., 30:1131-1138.*
Altintas, M. M., et al, "Improvement of Ethanol Production from Starch by Recombinant Yeast Through Manipulation of Environmental Factors," Enzyme and Microbial Technology, vol. 31, No. 5, 2002, pp. 640-647.
Aspegren, K., et al., "Secretion of Heat-Stable Fungal .beta.-Glucanase from Transgenic, Suspension-Cultured Barley Cells," Molecular Breeding, 1995, pp. 91-99.
Birch, R.G., Plant Transformation: Problems and Strategies for Practical Application, Annual Review of Plant Physiology and Plant Molecular Biology, vol. 48, Jun. 1997, pp. 297-326.
Bird, C.R., et al., The Tomato Polygalacturonase Gene and Ripening-Specific Expressions in Transgenic Plants, Plant Molecular Biology, 1988, pp. 651-662.

(Continued)

*Primary Examiner* — Jason Deveau Rosen
(74) *Attorney, Agent, or Firm* — Volpe and Koenig, P.C.

(57) ABSTRACT

Intein modified proteins, isolated nucleic acids encoding intein modified proteins, fragments of intein modified proteins, isolated nucleic acids encoding fragments of intein modified proteins, transgenic plants containing any of the foregoing, and antibodies recognizing epitopes on intein modified proteins are provided.

5 Claims, 49 Drawing Sheets

Specification includes a Sequence Listing.

(56) References Cited

OTHER PUBLICATIONS

Brederode, F.T., et al., Complete Nucleotide Sequence of Alfalfa Mosaic Virus RNA 4, Nucleic Acids Research, vol. 8, No. 10, 1980, pp. 2213-2223.
Broothaerts, W., et al., "Gene Transfer to Plants by Diverse Species of Bacteria," Nature, vol. 433, Feb. 2005, pp. 629-633/.
Bult et al., (1996) Complete genome sequence of the methanogenic archaeon, Methanococcus jannaschii. Science 273(5278): 1058-73. PubMed ID: 8688087.
Cambon-Bonavita et al., (2000) Cloning, expression, and characterization of DNA polymerase I from the hyperthermophilic archaea Thermococcus fumicolans. Extremophiles 4(4): 215-25. PubMed ID: 10972190.
Cameron, D.C., et al., "Metabolic Engineering of Propanediol Pathways," Biotechnology Progress, 1998, pp. 116-125.
Chen et al., "Herbicide Resistance from a Divided EPSPS Protein: The Split Synechocystis DnaE Intein as an In Vivo Affinity Domain", Gene: An International Journal of Genes and Genomes, vol. 263, pp. 39-48 (2001).
Chen et al., (2000) Protein splicing in the absence of an intein penultimate histidine. J Biol Chem 275(27): 20431-5. PubMed ID: 10770923.
Cheon, B.Y., et al., "Ovexpression of Human Erythropoietin (EPO) Affects Plant Morphologies: Retarded Vegetative Growth in Tobacco and Male Sterility in Tobacco and *Arabidopsis*," Transgenic Research, 2004, pp. 541-549.
Chih-Ching, C., et al., "Establishment of an Efficient Medium for Anther Culture of Rice Through Comparative Experiments on the Nitrogen Sources," Scientia Sinica, vol. 18, No. 3, 1975, pp. 659-668.
Chin et al., Protein trans-splicing in transgenic plant chloroplast: Reconstruction of herbicide resistance from split genes, PNAS, vol. 100, No. 8, pp. 4510-4515 (2003).
Chong et al., "Modulation of Protein Splicing of the *Saccharomyces cerevisiae* Vacuolar Membrane ATPase Intein," The Journal of Biological Chemistry, vol. 273, No. 17, pp. 10567-10577. (Apr. 24, 1998).
Chong, et al. ., "Single-column purification of free recombinant proteins using a self-cleavable affinity tag derived from a protein splicing element", Gene: An International Journal of Genes Genomes, vol. 192, pp. 271-281 (1997).
Chute et al., (1998) A topA intein in Pyrococcus furiosus and its relatedness to the r-gyr intein of Methanococcus jannaschii. Gene 210(1): 85-92. PubMed ID: 9524230.
Clarke, Neil D., "A Proposed Mechanism for the Self-Splicing of Proteins," Proceedings of the National Academy of Science, USA, vol. 91, pp. 11084-11088, Nov. 1994.
Coruzzi, G., et al., "Tissue-Specific and Light-Regulated Expression of Pea Nuclear Gene Coding the Small Subunit of Ribulose-1, 5-Bisphosphate Carboxylase," The EMBO Journal, 1984, 1671-1679.
Dai, Z., et al., "Expression of Acidothermus Cellulolyticus Endoglucanase E1 in Transgenic Tobacco: Biochemical Characteristics and Physiological Effects," Transgenic Research, 2000, pp. 43-54.
Dai, Z., et al., "Improved Plant-Based Production of E1 Endoglucanase Using Potato: Expression Optimization and Tissue Targeting," Molecular Breeding, 2000, pp. 277-285.
Dale, Bruce E., "Biobased Industrial Products: Bioprocess Engineering When Costs Really Count," Biotechnology Progress, 1999, pp. 775-776.
Dalgaard et al., (1997) Statistical modeling, phylogenetic analysis and structure prediction of a protein splicing domain common to inteins and hedgehog proteins. J Comput Biol 4(2): 193-214. PubMed ID: 9228618.
Davis, E., et al., "Novel Structure of the recA Locus of *Mycobacterium tuberculosis* Implies Processing of the Gene Product," Journal of Bacteriology, vol. 173, No. 18, Sep. 1991, pp. 5653-5662.

Davis, E., et al., "Protein Splicing in the Maturation of M. Tuberculosis RecA Protein: A Mechanism for Tolerating a Novel Class of Intervening Sequence," Cell Press, vol. 71, Oct. 16, 1992, pp. 201-210.
Davis et al., "Protein Splicing: The Lengths Some Proteins Will Go To" 1995, Antonie van Leeuwenhoek, vol. 67, pp. 131-137.
Deckert et al., (1998) The complete genome of the hyperthermophilic bacterium *Aquifex aeolicus*. Nature. 392(6674): 353-8. PubMed ID: 9537320.
Derbyshire, et al., "Lightning Strikes Twice: Intron-Intein Coincidence," Proceedings of the National Academy of Science, USA, vol. 95, pp. 1356-1357, Feb. 17, 1998.
Evans, et al., "Semisynthesis of Cytotoxic Proteins Using a Modified Protein Splicing Element," Protein Science, vol. 7: pp. 2256-2264 (1998).
Evans et al., (1999) The in vitro ligation of bacterially expressed proteins using an intein from Methanobacterium thermoautotrophicum. J Biol Chem 274(7): 3923-6. PubMed ID: 9933578.
Gangopadhyay, J.P., et. al., "In Vitro Splicing of Erythropoietin by the *Mycobacterium tuberculosis* RecA Intein Without Substituting Amino Acids at the Splice Junctions," Biochimica et Biophysica Acta, vol. 1619, (2003), pp. 193-200.
Genschik et al., (1997) The human RNA 3'-terminal phosphate cyclase is a member of a new family of proteins conserved in Eucarya, Bacteria and Archaea. Embo J. 16(10): 2955-67. PubMed ID: 9184239.
Genschik et al., (1998) Characterization of the *Escherichia coli* RNA 3'-terminal phosphate cyclase and its sigma54-regulated operon. J Biol Chem. 273(39): 25516-26. PubMed ID: 9738023.
Gimble, "Invasion of a Multitude of Genetic Niches by Mobile Endonuclease Genes" Feb. 8, 2000, FEMS Microbiology Letters, vol. 185, pp. 99-107.
Gordon-Kamm, et al., "Transformation of Maize Cells and Regeneration of Fertile Transgenic Plants," The Plant Cell, vol. 2, pp. 603-618, Jul. 1990.
Guilley, H., et al., "Transcription of Cauliflower Mosaic Virus DNA: Detection of Promoter Sequences, and Characterization of Transcripts," Cell, vol. 30, Oct. 1982, pp. 763-773.
Gupta, P.K., et al., "Shoot Multiplication from Mature Trees of Douglas Fir and Sugar Pine," Plant Cell Reports, vol. 4, 1985, pp. 177-179.
Hashimoto et al., (2000) Crystallographic study of intein homing endonuclease II encoded in the archaeal DNA polymerase gene. Acta Crystallogr D Biol Crystallogr 56 ((Pt 9)): 1185-6. PubMed ID: 10957641.
Hashimoto et al., (2001) Crystal structure of DNA polymerase from hyperthermophilic archaeon Pyrococcus kodakaraensis KOD1. J Mol Biol 306(3): 469-77. PubMed ID: 11178906.
Higgins, T.J.V., Synthesis and Regulation of Major Proteins in Seeds, Annual Review of Plant Physiology, 1984, pp. 191-221.
Hirata, R., et al., "Molecular Structure of a Gene, VMA1, Encoding the Catalytic Subunit of H.sup.+-Translocating Adenosine Triphosphatase fro Vacuolar Membranes of *Saccharomyces cerevisiae*," The Journal of Biological Chemistry, vol. 265, No. 12, Apr. 25, 1990, pp. 6826-6733.
Hodges et al., (1992) Protein splicing removes intervening sequences in an archaea DNA polymerase. Nucleic Acids Res 20(23): 6153-7. PubMed ID: 1475179.
Hood, E.E., et al., "Commercial Production of Avidin from Transgenic Maize: Characterization of Transformant, Production, Processing, Extraction and Purification," Molecular Breeding, 1997, pp. 291-306.
Horsch, R.B., et al, "A Simple and General Method for Transferring Genes into Plants," Science, Mar. 1985, pp. 1229-1231.
Ichiyanagi et al., (2000) Crystal structure of an archaeal intein-encoded homing endonuclease PI-PfuI. J Mol Biol 300(4): 889-901. PubMed ID: 10891276.
Ingram, L.O., et al., "Enteric Bacterial Catalysts for Fuel Ethanol Production," Biotechnology Progress, 1999, pp. 856-866.
Kane, P.M., et. al., "Protein Splicing Converts the Yeast TFP1 Gene Product to the 69-kD Subunit of the Vacuolar H+-Adenosine Triphosphatase," Science, New Series, vol. 250, No. 4981, Nov. 2, 1990, pp. 651-657.

(56) References Cited

OTHER PUBLICATIONS

Kawarabayasi et al., (1998) Complete sequence and gene organization of the genome of a hyper-thermophilic archaebacterium, Pyrococcus horikoshii OT3. DNA Res 5(2): 55-76. PubMed ID: 9679194.

Kawarabayasi et al., (1998B) Complete sequence and gene organization of the genome of a hyper-thermophilic archaebacterium, Pyrococcus horikoshii OT3 (supplement). DNA Res. 5(2): 147-55. PubMed ID: 9679203.

Kawarabayasi et al., (1999) Complete genome sequence of an aerobic hyper-thermophilic crenarchaeon, Aeropyrum pernix K1. DNA Res. 6(2):83-101, 145-52. PubMed ID: 10382966.

Kawarabayasi, Y. (2001) Genome of Pyrococcus horikoshii OT3. Methods Enzymol. 330: 124-34. PubMed ID: 11210494.

Kawashima et al., (1999) Determination of the complete genomic DNA sequence of Thermoplasma volvanium GSS1. Proc. Jpn. Acad 75: 213-218.

Klabunde et al., (1998) Crystal structure of GyrA intein from Mycobacterium xenopi reveals structural basis of protein splicing. Nat Struct Biol 5(1): 31-6. PubMed ID: 9437427.

Klein, T.M., et al., "High-Velocity Microprojectiles for Delivering Nucleic Acids Into Living Cells," Nature, vol. 327, May 1987, pp. 70-73.

Komori et al., (1999) Pl-Pful and Pl-Pfull, intein-coded homing endonucleases from Pyrococcus furiosus. I. Purification and identification of the homing-type endonuclease activities. Nucleic Acids Res 27(21): 416774. PubMed ID: 10518607.

Komori et al., (1999B) Pl-Pful and Pl-Pfull, intein-coded homing endonucleases from Pyrococcus furiosus. II. Characterization of the binding and cleavage abilities by site-directed mutagenesis. Nucleic Acids Res 27(21): 4175-82. PubMed ID: 10518608.

Lai et al., "Structural Characterization of Human Erythropoietin." The Journal of Biological Chemistry, vol. 261, pp. 3116-3121, Mar. 5, 1986.

Latif, F., et al., "Production of Ethanol and Xylitol from Corn Cobs by Yeasts," Bioresource Technology, vol. 77, 2001, pp. 57-63.

Lecompte et al., (2001) Genome evolution at the genus level: comparison of three complete genomes of hyperthermophilic archaea. Genome Res. 11(6): 981-93 . . . PubMed ID: 11381026.

Liu et al., (1997) A DnaB intein in Rhodothemius marinus: indication of recent intein homing across remotely related organisms. Proc Natl Acad Sci U S A 94(15): 7851-6. PubMed ID: 9223276.

Lynd, L.R., et al., "Biocommodity Engineering," Biotechnology Progress, vol. 15, 1999, pp. 777-793.

Maeder et al., (1999) Divergence of the hyperthermophilic archaea Pyrococcus furiosus and P. horikoshii inferred from complete genomic sequences. Genetics 152(4): 1299-305. PubMed ID: 10430560.

Mansfield, S.D., et al., "Substrate and Enzyme Characteristics that Limit Cellulose Hydrolysis," Biotechnology Progress, vol. 15, 1999, pp. 804-816.

Matsumoto, S., et al., "Characterization of Human Glycoprotein (Erythropoietin) Produced in Cultured Tobacco Cells," Plant Molecular Biology, 1995, pp. 1163-1172.

Montvalvo-Rodriguez, R., et al., "Autohydrolysis of Plant Polysaccharides Using Transgenic Hyperthermophilic Enzymes," Biotechnology and Bioengineering, vol. 2, 2000, pp. 151-159.

Morassutti et al., "Production of a Recombinant Antimicrobial Peptide in Transgenic Plants Using a Modified VMA Intein Expression System," FEBS Letters, vol. 519, Nos. 1-3, pp. 141-146 (Apr. 2002).

Murashige, T., et al., "A Revised Medium for Rapid Growth and Bio Assays with Tobacco Tissue Cultures," Physiologia Plantarum, vol. 15, pp. 473-497 (1962).

Ng et al., (2000) Genome sequence of Halobacterium species NRC-1. Proc Natl Acad Sci U S A. 97(22): 12176-81. PubMed ID: 11016950.

Niehaus et al., (1997) Cloning and characterisation of a thermostable alpha-DNA polymerase from the hyperthermophilic archaeon Thermococcus sp. TY. Gene 204(1-2): 153-8. PubMed ID: 9434178.

Nishioka et al., (1998) Characterization of two intein homing endonucleases encoded in the DNA polymerase gene of Pyrococcus kodakaraensis strain KOD1. Nucleic Acids Res 26(19): 4409-12. PubMed ID: 9742242.

Olsson, L., et al., "Fermentation of lignocellulosic Hydrolysates for Ethanol Production," Enzyme and Microbial Technology, vol. 18, 1996, pp. 312-331.

Otomo et al., (1999) Improved segmental isotope labeling of proteins and application to a larger protein. J Biomol NMR 14(2): 105-14. PubMed ID: 10427740.

Otomo et al., (1999B) NMR observation of selected segments in a larger protein: central-segment isotope labeling through intein-mediated ligation. Biochemistry 38(49): 16040-4. PubMed ID: 10587426.

Parsons, T.J., et al., "Transformation of Poplar by Agrobacterium Tumefaciens," Biotechnology, vol. 4, Jun. 1986, pp. 533-536.

Perler, et al. (1997) Compilation and analysis of intein sequences. Nucleic Acids Res 25(6): 1087-93. PubMed ID: 9092614.

Perler, "InBase: the Intein Database" Aug. 31, 2001, Nucleic Acids Research, vol. 30, No. 1. pp. 383-384.

Perler et al., (1992) Intervening sequences in an Archaea DNA polymerase gene. Proc Natl Acad Sci U S A. 89(12): 5577-81. PubMed ID: 1608969.

Perler, F.B., et al., "Protein Splicing Elements; Inteins and Exteins—A Definition of Terms and Recommended Nomenclature", Nucleic Acids Research, vol. 22, No. 7, Feb. 24, 1993, pp. 1125-1127.

Pietrokovski, "Conserved Sequence Features of Inteins (Protein Introns) and Their Use in Identifying New Inteins and Related Proteins" Aug. 10, 1994, Protein Science, vol. 3, pp. 2340-2350.

Pietrokovski, S. (1998) Modular organization of inteins and C-terminal autocatalytic domains. Protein Sci 7(1): 64-71. PubMed ID: 9514260.

Poirier, Yves, "Green Chemistry Yields a Better Plastic," Nature Biotechnology, vol. 17, Oct. 1999, pp. 960-961.

Riera et al., (1997) Ribonucleotide reductase in the archaeon Pyrococcus furiosus: a critical enzyme in the evolution of DNA genomes?. Proc Natl Acad Sci U S A 94(2): 475-8. PubMed ID: 9012808.

Rocha-Sosa, M., et al., "Both Developmental and Metabolic Signals Activate the Promoter of a Class I Patatin Gene," The EMBO Journal, vol. 8, No. 1, 1989, pp. 23-29.

Ruepp et al., (2000) The genome sequence of the themioacidophilic scavenger Thermoplasma acidophilum. Nature. 407(6803): 508-13. PubMed ID: 11029001.

Ryan, A.J., et al., Genomic Sequence of a 12S Seed Storage Protein from Oilseed Rape, Nucleic Acids Research, vol. 17, No. 9, 1989, p. 3584.

Saves et al., (2000) Inteins of Thermococcus fumicolans DNA polymerase are endonucleases with distinct enzymatic behaviors. J Biol Chem 275(4): 2335-41. PubMed ID: 10644683.

Saves et al., (2000C) The Thy pol-2 intein of Thermococcus hydrothermalis is an isoschizomer of Pl-Tlil and Pl-Tfull endonucleases. Nucleic Acids Res 28(21): 4391-6. PubMed ID: 11058140.

Schreier, P.H., et al., The Use of Nuclear-Encoded Sequences to Direct the Light-Regulated Synthesis and Transport of a Foreign Protein into Plant Chloroplasts, The EMBO Journal, vol. 4, No. 1, 1985, pp. 25-32.

Senejani et al., (2001) The intein of the Thermoplasma A-ATPase A subunit: structure, evolution and expression in E. coli. BMC Biochem 2: 13. PubMed ID: 11722801.

Shao et al., (1995) Protein splicing: characterization of the aminosuccinimide residue at the carboxyl terminus of the excised intervening sequence. Biochemistry 34(34): 10844-50. PubMed ID: 7662664.

Shao et al., (1996) Protein splicing: evidence for an N—O acyl rearrangement as the initial step in the splicing process. Biochemistry 35(12): 3810-5. PubMed ID: 8620003.

Shen et al., (2001) Invariant Asp-1122 and Asp-1124 are essential residues for polymerization catalysis of family D DNA polymerase from Pyrococcus horikoshii. J Biol Chem 276(29): 27376-83. PubMed ID: 11319225.

Shimamoto, K., et al., Fertile Transgenic Rice Plants Regenerated from Transformed Protoplasts, Nature, vol. 338, Mar. 1989, pp. 274-276.

(56) References Cited

OTHER PUBLICATIONS

Shingledecker et al., "Reactivity of the Cysteine Residues in the Protein Splicing Active Center of the *Mycobacterium tuberculosis* RecA intein" Mar. 1, 2000, Archives of biochemistry and biophysics, vol. 375, No. 1, pp. 138-144.
Sijmons, P.C., et al., Production of Correctly Processed Human Serum Albumin in Transgenic Plants, Biotechnology, vol. 8, Mar. 1990, pp. 217-221.
Smeekens, et al., "Protein Transport into and Within Chloroplasts," Trends in Biochemical Sciences, vol. 15, Feb. 1990, pp. 73-76.
Smith et al., (1997B) Complete genome sequence of Methanobacterium thermoautotrophicum deltaH: functional analysis and comparative genomics. J Bacteriol 179(22): 7135-55. PubMed ID: 9371463.
Southworth et al., (1998) Control of protein splicing by intein fragment reassembly. Embo J 17(4): 918-26. PubMed ID: 9463370.
Southworth et al., (1999) Purification of proteins fused to either the amino or carboxy terminus of the *Mycobacterium xenopi* gyrase A intein. Biotechniques 27(1): 110-4, 116, 118-20. PubMed ID: 10407673.
Southworth et al., (2000) An alternative protein splicing mechanism for inteins lacking an N-terminal nucleophile. Embo J 19(18): 5019-26. PubMed ID: 10990465.
Sreenath, H.K., et al., "Production of Ethanol from Wood Hydrolyzate by Yeasts," Bioresource Technology, vol. 72, No. 3, 2000, pp. 253-260.
Staub, J.M., et al., "High-Yield Production of a Human Therapeutic Protein in Tobacco Chloroplasts," Nature Biotechnology, vol. 18, Mar. 2000, pp. 333-338.
Stoddard et al., (1998) Breaking up is hard to do. Nat Struct Biol 5(1): 3-5. PubMed ID: 9437416.
Sun et al., "Protein trans-Splicing to Produce Herbicide-Resistant Acetolactate Synthase," Applied and Environmental Microbiology, vol. 67, No. 3, pp. 1025-1029 (Mar. 2001).
Tague, B.W., et al., "A Short Domain of the Plant Vacuolar Protein Phytohemagglutinin Targets Invertase to the Yeast Vacuole," The Plant Cell, vol. 2, Jun. 1990, pp. 533-546.
Takagi et al., (1997) Characterization of DNA polymerase from *Pyrococcus* sp. strain KOD1 and its application to PCR. Appl Environ Microbiol 63(11): 4504-10. PubMed ID: 9361436.
Taylor, F., et al., "Dry-Grind Process for Fuel Ethanol by Continuous Fermentation and Stripping," Biotechnology Progress, vol. 16, 2000. pp. 541-547.
Telenti et al., (1997) The *Mycobacterium xenopi* GyrA protein splicing element: characterization of a minimal intein. J Bacteriol 179(20): 6378-82. PubMed ID: 9335286.
Tingey, S.V., et al., "Glutamine Synthetase Genes of Pea Encode Distinct Polypeptides Which are Differentially Expressed in Leaves, Roots and Nodules," The EMBO Journal, vol. 6, No. 1, 1987, pp. 1-9.
Ulgen, K.O., et. al., "Bioconversion of Starch Into Ethanol by a Recombinant *Saccharomyces cerevisiae* Strain YPG-AB," Process Biochemistry, vol. 37, 2002, pp. 1157-1168.
Van Den Broeck, G., et al., Targeting of a Foreign Protein to Chloroplasts by Fusions to the Transmit Peptide from the Small Subunit of Ribulose 1,5-Bisphosphate Carboxylase, Nature, vol. 313, Ksmistu 1985, pp. 358-363.
Von Heijne, G., "Towards a Comparative Anatomy of N-Terminal Topogenic Protein Sequences," Journal of Molecular Biology, vol. 189, 1986, pp. 239-242.

Wallace, "The Curious Case of Protein Splicing: Mechanistic Insights Suggested by Protein Semisynthesis," Protein Science, vol. 2, pp. 697-705 (1993).
Wang et al., "Identification of an Unusual Intein in Chloroplast ClpP Protease of Chlamydomonas Eugametos" May 2, 1997, Journal of Biological Chemistry, vol. 272, No. 18, pp. 11869-11873.
Wenzler, H.C., et al., "Analysis of a Chimeric Class-I Patatin-GUS Gene in Transgenic Potato Plants: High-Level Expression in Tubers and Sucrose-Inducible Expressions in Cultured Leaf and Stem Explants," Plant Molecular Biology, vol. 12, 1989, pp. 41-50.
Wood, D.W., et al., "Optimized Single-Step Affinity Purification with a Self-Cleaving Intein Applied to Human Acidic Fibroblast Growth Factor," Biotechnology Progress, vol. 16, 2000, pp. 1055-1063.
Xu, M., et al., "In Vitro Protein Splicing of Purified Precursor and the Identification of Branched Intermediate," Cell, vol. 75, Dec. 31, 1993, pp. 1371-1377.
Xu et al., (1994) Protein splicing: an analysis of the branched intermediate and its resolution by succinimide formation. Embo J 13(23): 5517-22. PubMed ID: 7988548.
Xu, M., et al., "The Mechanism of Protein Splicing in its Modulation by Mutation," The EMBO Journal, vol. 15, No. 19, 1996, pp. 5146-5153.
Yamazaki et al., (1998) Segmental isotope labeling for protein NMR using peptide splicing. J. Am. Chem. Soc. 120: 5591-5592.
Yang, et al., "Intein-mediated assembly of a functional .beta.-glucuronidase in transgenic plants," PNAS, vol. 100, No. 6, pp. 3513-3518 (2003).
Ziegler, M.T., et al., "Accumulation of Thermostable Endo-1,4-.beta.-D-Glucanase in the Apoplast of *Arabidposis thaliana* Leaves," Molecular Breeding, vol. 6, 2000, pp. 37-46.
UNIPROT, P77853_DICTH, pp. 1-4 (Feb. 1, 1997).
Tokuda, G. et al. "Metazoan Cellulase Genes from Termites: Intron/Exon Structures and Sites of Expression" (1999) Biochimica et Biophysica Acta 1447: 146-159.
U.S. Office Action dated Sep. 27, 2017 for U.S. Appl. No. 15/002,280, filed Jan. 20, 2016.
Zeidler et al., "Temperature-sensitive control of protein activity by conditionally splicing inteins," Nature Biotechnology, vol. 22, No. 7, Jul. 2004, 871-876.
Shen et al., "Engineering a thermoregulated intein-modified xylanase into maize for consolidated lignocellulosic biomass processing," Nature Biotechnology, vol. 30, No. 11, Nov. 2012, 8 pages.
Office Action dated Sep. 27, 2017 in U.S. Appl. No. 15/002,280.
Perler, F.B. "InBase: the Intein Database" (2002) Nuc. Acid Res. 30(1): 383-384.
Jensen, L.G. et al., "Transgenic Barley Expressing a Protein-Engineered, Thermostable (1,3-1,4)-Beta-Glucanase during Germination" Proceedings of the National Academy of Sciences Apr. 1996, 93 (8) 3487-3491.
Herbers, K. et al. "Apoplastic Expression of the Xylanase and β(1-3, 1-4) Glucanase Domains of the XYN D gene from Ruminococcus Flavefaciens Leads to Functional Polypeptides in Transgenic Tobacco Plants" Molecular Breeding 2: 81-87, 1996.
Office Action dated Oct. 19, 2018 for U.S. Appl. No. 15/046,064.
Office Action dated May 30, 2018 for U.S. Appl. No. 15/046,064.
Sequence Record AAW30267 (on pp. 10-11 of Office Action dated May 30, 2018 for U.S. Appl. No. 15/046,064).

* cited by examiner

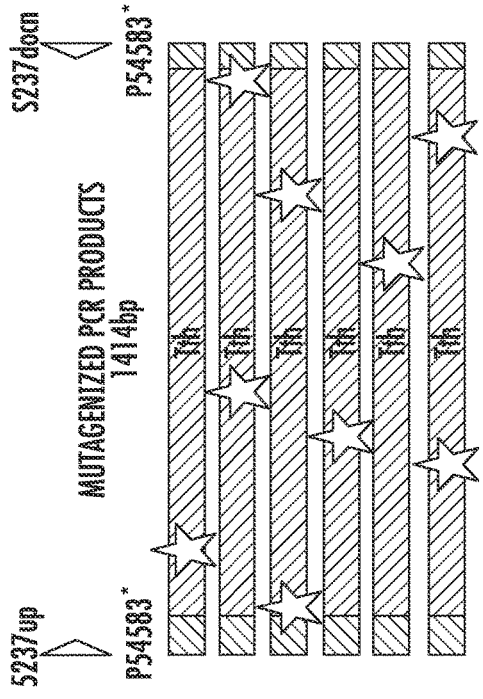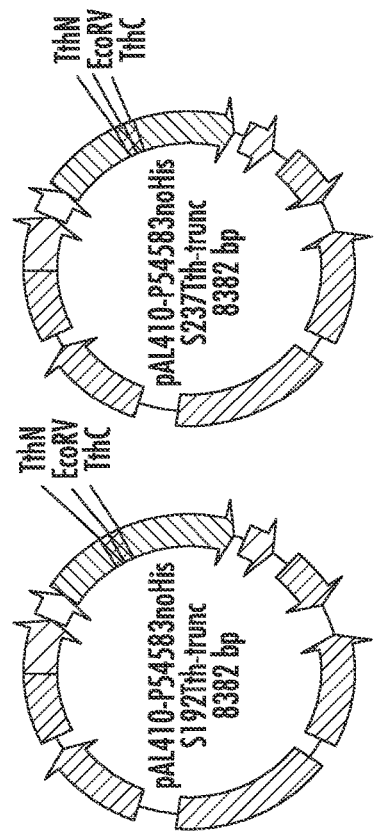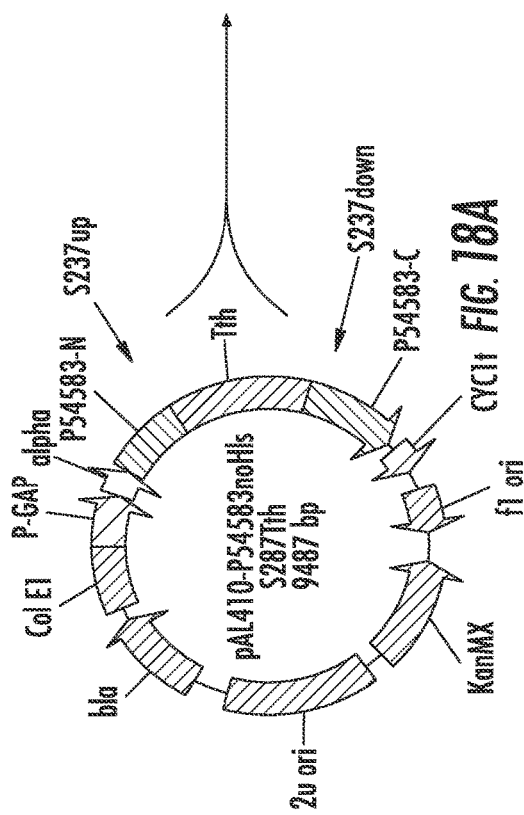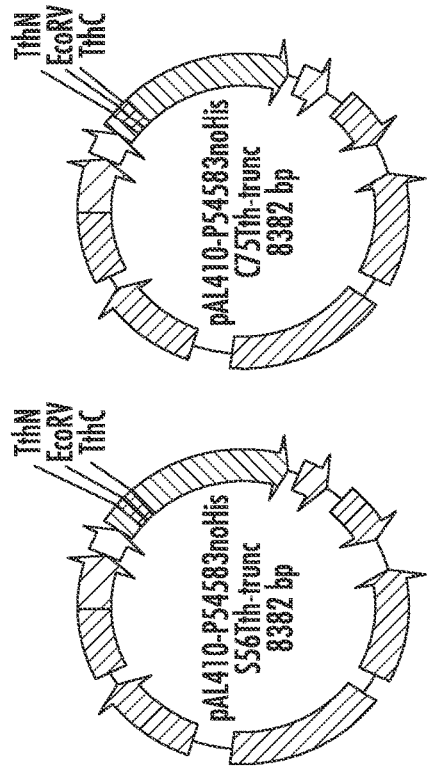
FIG. 18A  FIG. 18B  FIG. 18C

INTEIN-MODIFIED ENZYMES, THEIR PRODUCTION AND INDUSTRIAL APPLICATIONS

This application is a 35 U.S.C. § 371 national phase application of PCT/US10/55669, which was filed Nov. 5, 2010 and is incorporated herein by reference as if fully set forth.

This application is a continuation-in-part application of U.S. patent application Ser. No. 12/590,444, which was filed Nov. 6, 2009 and is incorporated herein by reference as if fully set forth.

The sequence listing electronically filed with this application titled "Sequence Listing," which was created on Nov. 5, 2010, and had a size of 7,617,396 bytes is incorporated by reference herein as if fully set forth.

FIELD OF INVENTION

The invention relates to controlling the activity of proteins.

BACKGROUND

Many proteins have useful characteristics but in certain settings a protein can be difficult to use. For example, hydrolytic enzymes have important industrial and agricultural applications, but their expression and production may be associated with undesirable phenotypic effects in some expression hosts. Cell wall degrading enzymes, which include cellulases, xylanases, ligninases, esterases, peroxidases, and other hydrolytic enzymes, are often associated with detrimental effects on growth, physiological performance, and agronomic performance when expressed in plants. Xylanases are enzymes that catalyze the hydrolysis of beta-1,4-xylan, a linear polysaccharide component of hemicellulose contained in plant cell walls. Cellulases are enzymes that catalyze either the internal or terminal hydrolysis of glucose polymers linked by beta-1,4-D-glycosidic bonds contained in cellulose, cellulose strains with different degrees of polymerization, and cellobiose. Based on these activities, expression of a xylanase or a cellulase in a plant may lead to undesirable degradation of plant components. Some enzymes may also be poorly expressed in microbial hosts, due to their hydrolytic activity.

SUMMARY

In an aspect, the invention relates to an isolated protein having an amino acid sequence with at least 90% identity to a sequence selected from the group consisting of SEQ ID NOS: 2059-2089.

In an aspect, the invention relates to an isolated nucleic acid having a nucleotide sequence encoding an amino acid sequence with at least 90% identity to a sequence selected from the group consisting of SEQ ID NOS: 2059-2089.

In an aspect, the invention relates to a transgenic plant comprising an isolated protein having an amino acid sequence with at least 90% identity to a sequence selected from the group consisting of SEQ ID NOS: 2059-2089.

In an aspect, the invention relates to an isolated amino acid sequence comprising a contiguous amino acid sequence having at least 90% identity to 6, 10 to 50, 10 to 100, 10 to 150, 10 to 300, 10 to 400, 10 to 500, 10 to 600 or 10 to 658 contiguous amino acid residues of a protein having the sequence of any one of SEQ ID NOS: 2059-2089. The protein has an intein sequence, an enzyme sequence, an upstream intein-extein junction, a downstream intein-extein junction and at least one amino acid change relative to at least one of SEQ ID NO: 111 or SEQ ID NO: 91 The isolated amino acid sequence includes at least one of the upstream intein-extein junction, the downstream intein-extein junction or one or more of the at least one amino acid change relative to at least one of SEQ ID NO: 111 or SEQ ID NO: 91.

In an aspect, the invention relates to an antibody recognizing an epitope on an isolated amino acid sequence comprising a contiguous amino acid sequence having at least 90% identity to 6, 10 to 50, 10 to 100, 10 to 150, 10 to 300, 10 to 400, 10 to 500, 10 to 600 or 10 to 658 contiguous amino acid residues of a protein having the sequence of any one of SEQ ID NOS: 2059-2089. The protein has an intein sequence, an enzyme sequence, an upstream intein-extein junction, a downstream intein-extein junction and at least one amino acid change relative to at least one of SEQ ID NO: 111 or SEQ ID NO: 91 The isolated amino acid sequence includes at least one of the upstream intein-extein junction, the downstream intein-extein junction or one or more of the at least one amino acid change relative to at least one of SEQ ID NO: 111 or SEQ ID NO: 91.

In an aspect, the invention relates to an isolated nucleic acid having a sequence encoding a contiguous amino acid sequence having at least 90% identity to 6, 10 to 50, 10 to 100, 10 to 150, 10 to 300, 10 to 400, 10 to 500, 10 to 600 or 10 to 658 contiguous amino acid residues of a protein having the sequence of any one of SEQ ID NOS: 2059-2089. The protein has an intein sequence, an enzyme sequence, an upstream intein-extein junction, a downstream intein-extein junction and at least one amino acid change relative to at least one of SEQ ID NO: 111 or SEQ ID NO: 91. The isolated nucleic acid encodes at least one of the upstream intein-extein junction, the downstream intein junction or one or more of the at least one amino acid change relative to at least one of SEQ ID NO: 111 or SEQ ID NO: 91.

BRIEF DESCRIPTION OF THE DRAWINGS

The following detailed description of the preferred embodiments will be better understood when read in conjunction with the appended drawings. For the purpose of illustrating the invention, there are shown in the drawings embodiments which are presently preferred. It is understood, however, that the invention is not limited to the precise arrangements and instrumentalities shown. In the drawings:

FIG. 3A illustrates a western blot showing the P77853-Tth-S158-2 protein (SEQ ID NO: 1672) that was preheat treated at 37° C. (panel 2, left lane) or 55° C. (panel 2, right lane) for four hours. Also shown are lanes containing protein from the empty vector control (VCT) and wild-type P77853 protein (P77) that was preheat treated in the same manner.

FIG. 3B illustrates a western blot showing the P77853-Tth-S158-4 protein (SEQ ID NO: 1673) that was preheat treated at 37° C. (panel 4, left lane) or 55° C. (panel 4, right lane) for four hours. Also shown are lanes containing protein from the empty vector control (VCT) and wild-type P77853 protein (P77) that was preheat treated in the same manner.

FIG. 3C illustrates a western blot showing the P77853-Tth-S158-7 protein (SEQ ID NO: 1674) that was preheat treated at 37° C. (panel 7, left lane) and 55° C. (panel 7, middle lane) for four hours, and 70° C. for one hour (panel 7, right lane). Also shown are lanes containing protein from the empty vector control (VCT) and wild-type P77853 protein (P77).

FIG. 3D illustrates a western blot showing the P77853-Tth-S158-19 protein (SEQ ID NO: 1675) that was preheat treated at 37° C. (panel 19, left lane) or 55° C. (panel 19, middle lane) for four hours, and 70° C. for one hour (panel 19, left lane). Also shown are lanes containing protein from the empty vector control (VCT) and wild-type P77853 protein (P77).

FIG. 3E illustrates a western blot showing the P77853-Tth-S158-20 protein (SEQ ID NO: 1676) that was preheat treated at 37° C. (panel 20, left lane) or 55° C. (panel 20, middle lane) for four hours, and 70° C. for one hour (panel 20, right lane). Also shown are lanes containing protein from the empty vector control (VCT) and wild-type P77853 protein (P77).

FIG. 3F illustrates a western blot showing the P77853-Tth-S158-21 protein (SEQ ID NO: 1677) that was preheat treated at 37° C. (panel 21, left lane) or 70° C. (panel 21, right lane) for one hour. Also shown are lanes containing protein from the empty vector control (VCT) and wild-type P77853 protein (P77) that was preheat treated in the same manner.

FIG. 3G illustrates a western blot showing the P77853-Tth-S158-25 protein (SEQ ID NO: 1678) that was preheat treated at 37° C. (panel 25, left lane) or 70° C. (panel 25, right lane) for one hour. Also shown are lanes containing protein from the empty vector control (VCT) and wild-type P77853 protein (P77) that was preheat treated in the same manner.

FIG. 3H illustrates a western blot showing the P77853-Tth-S158-38 protein (SEQ ID NO: 1679) that was preheat treated at 37° C. (panel 38, left lane) or 55° C. (panel 38, right) for four hours. Also shown are lanes containing protein from the empty vector control (VCT) and wild-type P77853 protein (P77) that was preheat treated in the same manner.

FIG. 3I illustrates a western blot showing the P77853-Tth-S158-39 protein (SEQ ID NO: 1680) that was preheat treated at 37° C. (panel 39, left lane) or 55° C. (panel 39, middle lane) for four hours, and 70° C. for one hour (panel 39, right lane). Also shown are lanes containing protein from the empty vector control (VCT) and wild-type P77853 protein (P77).

FIG. 3J illustrates a western blot showing the P77853-Tth-S158-42 protein (SEQ ID NO: 1681) that was preheat treated at 37° C. (panel 42, left lane) or 55° C. (panel 42, middle lane) for four hours, and 70° C. for one hour (panel 42, right lane). Also shown are lanes containing protein from the empty vector control and wild-type P77853 protein.

FIG. 3K illustrates a western blot showing the P77853-Tth-S158-138 protein (SEQ ID NO: 1691) that was preheat treated at 37° C. (left lane) or 59° C. (second from left lane) for four hours. Also shown are lanes containing protein from the empty vector control (VCT) and wild-type P77853 protein (P77853).

FIG. 3L illustrates a western blot showing the P77853-Tth-T134-1 protein (SEQ ID NO: 1629) (panel 1), P77853-Tth-T134-2 protein (SEQ ID NO: 1630) (panel 2), P77853-Tth-T134-3 protein (SEQ ID NO: 1631) (panel 3), P77853-Tth-T134-9 protein (SEQ ID NO: 1632) (panel 9), P77853-Tth-T134-91 protein (SEQ ID NO: 1644) (panel 91), P77853-Tth-T134-48 protein (SEQ ID NO: 1638) (panel 48), P77853-Tth-T134-80 protein (SEQ ID NO: 1640) (panel 80), and P77853-Tth-T134-95 protein (SEQ ID NO: 1645) (panel 95) that were preheat treated at 37° C. (left lane in each of the before mentioned panels) and 70° C. (right lane in each of the before mentioned panels) for one hour. Also shown are lanes containing protein from the empty vector control (VCT) and wild-type P77853 protein (P77) that was preheat treated in the same manner. The phenotype of each protein is given above its corresponding lanes.

FIG. 4A illustrates a western blot analysis for S158-19 Tth intein-modified P77853 xylanase (SEQ ID NO: 1675). Protein samples were incubated at 59° C. for different amounts of time (0, 1, 2, 3, 4, and 6 hours). The empty vector (Vect) and wild-type P77853 control samples are shown on the far right along with a molecular weight ladder. The grayed out middle area is to cover lanes that contained other samples.

FIG. 4B illustrates a western blot analysis for S158-30-103 Tth intein-modified P77853 xylanase (SEQ ID NO: 1701). Protein samples were incubated at either 37° C., 50° C., 59° C., and 65° C. for different amounts of time (1, 2, 3, 4, and 6 hours) as indicated. The empty vector (Vect) and wild-type P77853 control samples are shown on the far right along with a molecular weight ladder.

FIG. 4C illustrates a western blot analysis for T134-100-101 Tth intein-modified P77853 xylanase (SEQ ID NO: 1711). Protein samples were incubated at either 37° C., 50° C., 59° C., and 65° C. for different amounts of time (1, 2, 4, 6, and 17 hours) as indicated. The empty vector (V) and wild-type P77853 control (P) samples are shown on the far right along with a molecular weight ladder.

FIGS. 18A-C illustrate error prone PCT to generate mutagenized libraries.

DETAILED DESCRIPTION OF THE PREFERRED EMBODIMENTS

Figure 1:
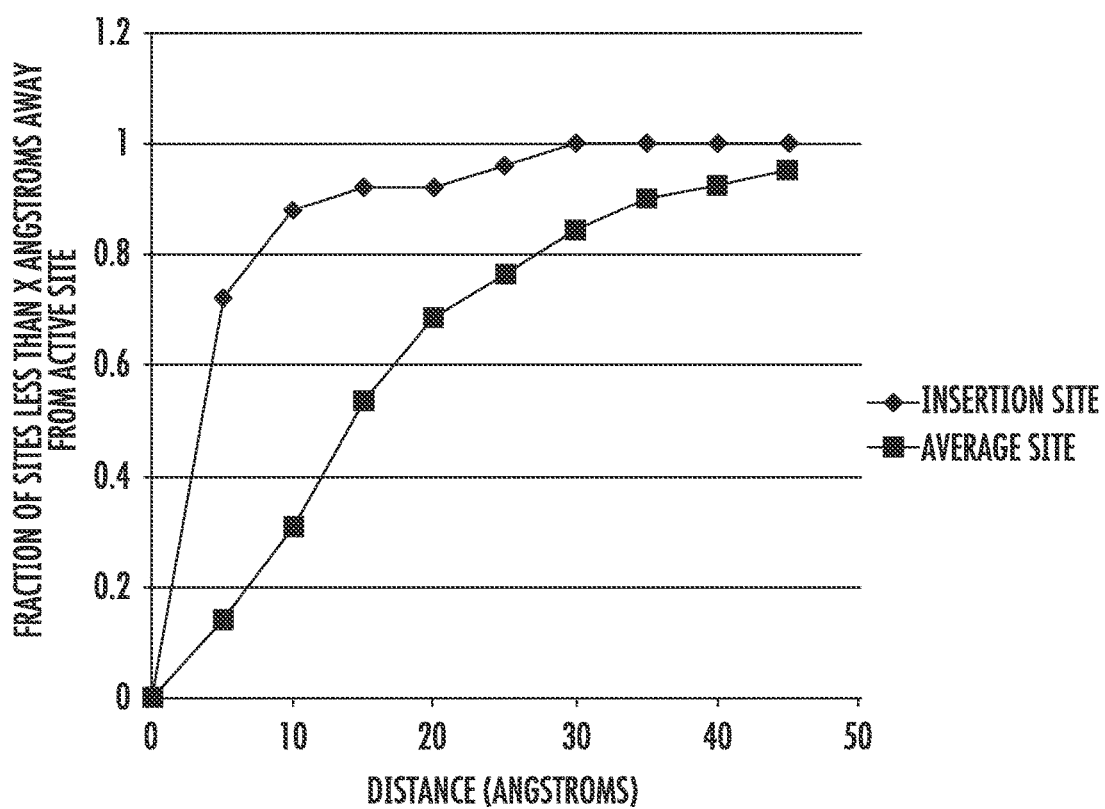
FIG. 1 illustrates intein insertion site distance from a protein active site. Diamonds indicated insertion sites and squares indicate other C/S/T sites where no intein is inserted.

Unless defined otherwise, all technical and scientific terms used herein have the meaning commonly understood by a person skilled in the art to which this invention belongs. The methods of the embodiments herein may be substituted or combined with other screening and application methods known to those of skill in the art. The phrase "at least one" followed by a list of two or more items, such as "A, B or C," means any individual one of A, B or C as well as any combination thereof.

As used herein, "extein," refers to the portion of an intein modified protein that is not part of the intein.

As used herein, "amino terminal extein," "N-terminal extein" or "N-extein" are synonymous and refer to an extein that is positioned prior to the N-terminal residue of the intein. The carboxy terminus of an amino terminal extein, N-terminal extein or N-extein is fused to the amino terminus of the intein in an assembled intein modified protein.

As used herein, "carboxy terminal extein," "C-terminal extein," or "C-extein" are synonymous and refer to an extein that is positioned after the C-terminal residue of the intein. The amino terminus of a carboxy terminal extein, C-terminal extein or C-extein is fused to the carboxy terminus of the intein in an assembled intein modified protein.

As used herein, "target protein" is a protein in which an intein is inserted or that is a candidate for insertion of an intein. Prior to intein insertion, respective portions of the target protein may be referred to as an extein, amino terminal extein, or carboxy terminal extein based on the intended insertion site.

A "target protein" can be an enzyme, and the term "target enzyme" means a "target protein" that is an enzyme.

As used herein, "permissive" or "P" refers to intein modification where the intein modified protein retains function after intein insertion, or the intein is cleaved or spliced from the protein to leave extein or ligated protein with function.

As used herein, "non-permissive" or "NP" refers to intein modification where the intein modified protein has reduced function after intein insertion.

As used herein, "temperature-sensitive" refers to an intein modification where the intein modified protein has greater function after exposure to the temperature or range of temperatures, or the intein is spliced from the protein to leave extein or ligated protein with greater function after exposure to the temperature or range of temperatures.

As used herein, "switching" refers to an activity change of an intein modified protein in response to a physical or chemical condition change. An intein modification that results in a "switching" or "switcher" intein-modified protein is non-permissive prior to the change in condition and permissive after the change in condition. Switching may occur based on the presence of the intein, cleavage of the intein from an extein, or cleavage of the intein and ligation of the exteins.

As used herein, "temperature-sensitive switcher splicer" or "TSP," refers to an intein modified protein where the intein splices in response to an induction temperature or temperature range. The intein modified protein may be non-permissive prior to exposure to temperatures other than the induction temperature or temperature range and permissive after exposure to the induction temperature or temperature range.

"Isolated nucleic acid," "isolated polynucleotide," "isolated oligonucleotide," "isolated DNA," or "isolated RNA" as used herein refers to a nucleic acid, polynucleotide, oligonucleotide, DNA, or RNA separated from the organism from which it originates or from the naturally occurring genome, location, or molecules with which it is normally associated, or that was made through a synthetic process.

"Isolated protein," "isolated polypeptide," "isolated oligopeptide," or "isolated peptide" as used herein refers to a protein, polypeptide, oligopeptide or peptide separated from the organism from which it originates or from the naturally occurring location, or molecules with which it is normally associated.

As used herein, "variant" refers to a molecule that retains a biological activity that is the same or substantially similar to that of the original sequence. The variant may be from the same or different species or be a synthetic sequence based on a natural or prior molecule.

Nucleic acids, nucleotide sequences, proteins or amino acid sequences referred to herein can be isolated, purified, synthesized chemically, or produced through recombinant DNA technology. All of these methods are well known in the art.

As used herein, "operably linked" refers to the association of two or more biomolecules or portions of one or more biomolecules in a configuration relative to one another such that the normal function of the biomolecules can be performed. In relation to nucleotide sequences, "operably linked" refers to the association of two or more nucleic acid sequences, by means of enzymatic ligation or otherwise, in a configuration relative to one another such that the normal function of the sequences can be performed. For example, the nucleotide sequence encoding a presequence or secretory leader is operably linked to a nucleotide sequence for a polypeptide if it is expressed as a preprotein that participates in the secretion of the polypeptide; a promoter or enhancer is operably linked to a coding sequence if it affects the transcription of the coding sequence; and a ribosome binding site is operably linked to a coding sequence if it is positioned so as to facilitate translation of the sequence.

Isolated proteins with controlled activity, isolated nucleic acids that encode the isolated proteins, methods of determining intein insertion sites, and methods to control the activity of proteins are provided. The proteins or nucleic acids may be provided in plants, microbes, and other organisms. Through the control, one or more of the proteins or nucleic acids could be used in the production of fuels, fiber, dough, chemicals, sugars, textiles, pulp, paper, human food, or animal feed. Preferably, the proteins or nucleic acids do not readily interfere with one or more of growth, physiology or other performance characteristics of the expression host. The protein to be controlled may be an enzyme but could be any kind of protein, including a non-enzyme, a structural protein, or a hormone.

One way to control protein activity is with inteins and the control may allow expression of an intein modified protein with a predefined activity level. Inteins are self-cleaving and self-ligating peptides. The collective attributes of being both self-cleaving and self ligating are referred to as "self-splicing" or "splicing." An intein cleaves from the protein and mediates ligation of the protein sequences (exteins) from which it cleaves to splice the protein. An intein may be inserted internally to the protein sequence or fused terminally to the protein. A intein insertion in a protein may allow control of a protein by yielding a protein that has one activity when the intein is present and another activity after intein cleavage or splicing. In some cases, the intein splicing reaction can be controlled by one or more of a variety of induction conditions. When an activity normally detrimental to the host is reduced, the intein may protect the expression host from detrimental growth, physiological, or yield effects of the protein. After expression of the protein, the activity could be changed by exposing the modified protein to reaction conditions that induce intein splicing. The protein that results after splicing may have increased activity. In an embodiment, the intein modification is non-permissive at low temperatures and permissive at higher temperatures such that the intein modified protein switches when the temperature is changed from low to higher temperatures. In some embodiments, however, the enzyme has lower activity after cleavage and/or ligation. A nucleic acid encoding the intein modified protein may be codon optimized for expression in a plant. Target proteins that can be modified with an intein in the present embodiments include but are not limited to cell wall degrading enzymes, lignocellulosic degrading enzymes, xylanases and cellulases. All proteins disclosed herein can be a target protein for intein modification.

The target protein may be modified with an intein selected from Mth, Psp-Pol, mini Psp-Pol (mPsp-Pol), RecA, Tac, Tag, Tth, mini Tth inteins, or derivatives thereof. Mth, Psp-Pol, mini Psp-Pol, RecA, Tac, Tag, Tth, and mini Tth (mTth) inteins may include the sequence of SEQ ID NOS: 2, 3, 4-87, 88, 89, 90, 91, and 92-103, respectively. An intein may, however, be from another source or a modified form of a natural intein.

Isolated intein modified xylanases are provided. Embodiments of the intein-modified xylanases have a different activity before and after intein cleavage or intein splicing. In an embodiment, intein cleavage or splicing is induced by exposure of the intein-modified xylanase to an induction condition. The induction condition can be but is not limited to an elevated temperature. The elevated temperature can be within but is not limited to the range of 50-70° C., which includes the temperatures of 50° C. and 70° C., or a sub-range between any two integers within said range. The elevated temperature can be greater than or equal to a temperature in integer increments within the range of 25-70° C., endpoint included. The elevated temperature can be greater than or equal to 50° C., 55° C., 59.9° C., 60° C., 65° C., or 70° C. A nucleic acid encoding an intein modified xylanase is preferably, but not necessarily, codon optimized for expression in a plant. In an embodiment, an intein modified xylanase can be expressed in a transgenic plant.

Isolated intein modified cellulases are provided. Embodiments of the intein modified cellulases have a different activity before and after intein cleavage or intein splicing. In an embodiment, intein cleavage or splicing is induced by exposure of the intein-modified cellulase to an induction condition. The induction condition can be but is not limited to elevated temperature. The elevated temperature can be within but is not limited to the range of 50-70° C., which includes the temperatures of 50° C. and 70° C., or sub-ranges between any two integers within said range. The elevated temperature can be greater than or equal to a temperature in integer increments within the range of 25-70° C. The elevated temperature can be greater than or equal to 45° C., 50° C., 55° C., 60° C., 62° C., or 65° C. A nucleic acid encoding the intein modified cellulase is preferably, but not necessarily, codon optimized for expression in a plant. In an embodiment, the intein modified cellulase can be expressed in a transgenic plant.

Xylanases that can be target proteins include but are not limited to Beta-1,4-xylanase 229B from *Dictyoglomus thermophilum*, (accession number P77853, SEQ ID NO: 104), endo-1,4-beta-xylanase from *Clostridium thermocellum* (accession number P51584, SEQ ID NO: 105), an alkaline thermostable endoxylanase precursor from *Bacillus* sp. NG-27 (accession number O30700, SEQ ID NO: 106), endo-1,4-beta-xylanase from *Thermomyces lanuginosus* (accession number O43097, SEQ ID NO: 107), and a thermal stable celloxylanase from *Clostridium stercorarium* (accession number P40942, SEQ ID NO: 108). Xylanases can be modified with one or more of several inteins, including, but not limited to at least one selected from Mth, Psp-Pol, mini Psp-Pol, RecA, Tac, Tag, Tth, mini Tth inteins or derivatives thereof. In an embodiment, the Mth, Psp-Pol, mini Psp-Pol, RecA, Tac, Tag, Tth, or mini Tth inteins have the sequence of SEQ ID NOS: 2, 3, 4-87, 88, 89, 90, 91, or 92-103, respectively. An intein or multiple inteins can be inserted into one or more of multiple candidate sites in xylanases.

Cellulases that can be target proteins include but are not limited to *Clostridium thermocellum* celK cellulase (accession number O68438 (SEQ ID NO: 109)), the *Thermomonospora fusca* celB cellulase (accession number P26222 (SEQ ID NO: 110)), the Ace1 Endoglucanase E1 from *Acidothermus cellulolyticus* (accession number P54583 (SEQ ID NO: 111)), and the *Nasutitermes takasagoensis* NtEG cellulase (accession number O77044 (SEQ ID NO: 112)). Cellulases can be modified with one or more of several inteins, including, but not limited to at least one selected from Mth, Psp-Pol, mini Psp-Pol, RecA, Tac, Tag, Tth, mini Tth inteins or derivatives thereof. In an embodiment, the Mth, Psp-Pol, mini Psp-Pol, RecA, Tac, Tag, Tth, or mini Tth inteins have the sequence of SEQ ID NOS: 2, 3, 4-87, 88, 89, 90, 91, or 92-103, respectively. An intein or multiple inteins can be inserted into one or more of multiple candidate sites in cellulases.

An intein modified protein can be produced by standard molecular biological techniques and then screened. The intein, the target protein, or the intein modified protein can be subjected to mutation and then screened. Screening systems that can be utilized include lambda phage, yeast, or other expression systems that allow production of the protein and/or testing of its physical and/or functional characteristics. From an intein modified protein or mutant intein modified protein population, candidates can be isolated and analyzed further. Further analysis may include DNA sequencing, functional assays, structural assays, enzyme activity assays, and monitoring changes in activity, structure, or splicing in response to induction conditions.

Induction conditions can include exposure of the intein modified protein to changes in physical or chemical conditions such as, but not limited to, changes in temperature, pH, concentration of splicing inhibitors, concentration of ligand, light, salt conditions, and pressure. Natural or mutant inteins can be screened to determine induction conditions. Further, inteins can be derived from organisms adapted to life at a desired induction condition. For example, temperature induced inteins may be isolated from psychrophiles, mesophiles, or thermophiles (for example, *Nanoarchaeum equitans*, *Pyrococcus abyssi*, or *Pyrococcus* sp.); pH induced inteins may be isolated from acidophiles, alkaliphiles, or neutrophiles (for example, *Pyrococcus* sp., *Mycobacterium tuberculosis*, *Saccharomyces cerevisiae*); and salt induced inteins may be isolated from halophiles. Chemically induced or inhibited inteins have also been identified. As non-limiting examples of chemically induced or inhibited inteins, the vacuolar ATPase subunit (VMA) intein isolated from *Saccharomyces cerevisiae* cleaves inducibly by exposure to DTT, $NH_2OH$, or cysteine; and inteins isolated from *Mycobacterium* and others from *Saccharomyces* have been show to have inhibited splicing in the presence of $Zn^{2+}$. Induction of inhibited inteins may occur by removing the inhibiting condition. Natural inteins may also be mutated and screened to determine if the mutation(s) resulted in an intein that is inducible at a desired induction condition. An intein from any of these sources may be provided in an intein modified protein.

Intein insertion sites can be determined experimentally. To determine if an insertion site will permit intein splicing, the intein-protein fusion gene can be constructed and cloned using known methods in the art, the intein-modified protein can be expressed, and the intein-modified protein tested for its ability to splice either spontaneously or under induction conditions.

To avoid adding any additional amino acids to the protein, and thereby potentially altering the protein's function or activity, native cysteines, serines, and threonines that occur within a protein may be screened as potential intein insertion sites. After insertion, the protein can be tested before and after intein cleavage and/or ligation for alteration of its function.

Inteins can be inserted into a protein at any place by adding a cysteine, serine, or threonine at the new junction site. The cysteine, serine, or threonine can be added by substitution of an amino acid within the protein sequence or insertion of the cysteine, serine, or threonine. When an intein is inserted at the new junction site, the carboxy terminus of the intein will be fused to the first amino acid of the amino terminus of the carboxy extein. If an additional cysteine, serine, or threonine is placed in a protein to facilitate intein insertion, then this amino acid will be left within the protein following the splicing reaction. Additional amino acids left in a mature protein following the splicing reaction may interfere with the protein's function or activity, thus one could confirm the function and activity of any protein resulting from such a splicing reaction that contains an additional amino acid. Functional assays are known in the art to determine the function of any known protein that has been assigned a function.

Because many proteins contain multiple cysteines, serines, and threonines, it may be desirable to rank order, or even limit, the number of insertion sites that are tested for intein splicing. Three features that can be used to predict an intein insertion site are: A) the local sequence as described by a support vector machine (SVM), B) the distance of the insertion site to the active site residues, and C) the proximity of the insertion site to a local secondary structure (e.g., at or near the end of an alpha-helix or beta-sheet). In an embodiment, the local sequence and distance to the active site are used to narrow the selection of proposed insertion sites, while the secondary structure element information can be used to prioritize similar insertion sites.

A) The Local Sequence

An SVM method can be used to predict or evaluate intein insertion sites. A suitable training set of known intein insertion site can be assembled from known native intein insertion sites. Known intein insertion sites sequences for this purpose can be found in the NEB inbase database as described in Perler, F. B. (2002), *InBase, The Intein Database*, Nuc. Acids Res. 30: 383-384, which is incorporated herein in its entirety as if fully set forth. Preferably, the training set intein insertion sites have the sequences of SEQ ID NOS: 1233-1512. One source of protein sequence for this purpose is the NCBI database but many other sources are available. The intein containing proteins corresponding to the SEQ ID NOS: 1233-1512 training set intein insertion sites have the sequences of SEQ ID NOS: 393-672, respectively. Based on the intein sequences (SEQ ID NOS: 113-392) and the intein containing protein sequences (SEQ ID NOS: 393-672)), the extein sequences of each intein containing protein can be separated from each intein sequence. The N-exteins in the protein sequences of SEQ ID NOS: 393-672 are presented in SEQ ID NOS: 673-952, respectively, and the C-exteins in the protein sequences of SEQ ID NOS: 393-672 are presented in SEQ ID NOS: 953-1232, respectively. For the generation of the SVM sequence prediction, the cassette, which includes the insertion site X and the sequence surrounding X in the N- and C-exteins, is determined. Preferably, the sequence analyzed includes a −3 to +2 (6 amino acids total, numbered as −3, −2, −1, 0, 1, 2) amino acid cassette surrounding X (a sequence of NNNXNN where X is the 0 amino acid). The following description applies to the NNNXNN cassette as a model for the SVM. If a cassette other than NNNXNN is utilized, then the SVM is modified as will be readily apparent from the description herein.

The cassette is converted to a vector V using the following equations:

$$V=[site_{-3}\ site_{-2}\ site_{-1}\ site_0\ site_{+1}\ site_{+2}]$$

where $$site_i=[aa_iALA\ aa_iARG\ \ldots\ aa_iTRP\ aa_iTYR]$$

$aa_iN=1$ if amino acid type N is present at site i; otherwise, N=0. This converts the cassette sequence of six amino acids into a 1 by 120 vector. The insertion site cassette for the intein containing proteins of SEQ ID NOS: 393-672 is provided in SEQ ID NOS: 1233-1512, respectively. This set of vectors for insertion site cassettes is used as the true positives control set to train the SVM. From each protein with a true positive, three random NNNXNN cassettes with cysteine, threonine and serine (referred to herein as "C/T/S") at the X (0) position, but no intein insertion, are also chosen from the N and C extein sequences (preferably from SEQ ID NOS: 673-1232) as true negatives. The set of true negatives from extein sequences are then compiled. A selected true negative may be from the same protein as the true positive insertion site and have the same residue type in the X position as the true positive.

The total SVM for prediction of intein insertion sites is trained on the entire set of intein insertion site sequences, removing any sequences that are identical. This can be done by implementing any one of a number of different methods or programs. One SVM program that can be used for prediction of intein insertion sites is SVM_light V6.02 (Aug. 14, 2008), which is incorporated by reference herein as if fully set forth and is available from Thorsten Joachims Weichgut LLC, Ithaca, N.Y. See also Thorsten Joachims, Making large-Scale SVM Learning Practical. Advances in Kernel Methods—Support Vector Learning, B. Schölkopf and C. Burges and A. Smola (ed.), MIT-Press, 1999, which is incorporated by reference herein as if fully set forth. Briefly, SVM_light V6.02 is an implementation of the support vector machine training method of the above referenced Joachims 1999 publication that accounts for the difficulty of larger training sets associated with large-scale problems. The algorithm is based upon a decomposition strategy that addresses these issues with selecting variables for the working set in an efficient way. With SVM_light V6.02 a linear kernel and cost-factor set to 1 are utilized so the errors in the positive and negative sets are equally weighted.

To test the validity of this method, smaller sets of insertion site cassettes can be chosen for training and testing using the following method: 1) A random set of m true positive training set insertion sites with unique sequences are selected (in an embodiment, m ranges from 1 to 250, and the sequences are selected from SEQ ID NOS: 1233-1512); 2) for each true positive insertion site, three corresponding true negative cassettes are randomly selected from the exteins of the same intein containing protein (in an embodiment, SEQ ID NOS: 673-1232) associated with the true positive insertion site, where the true negatives have the same central amino acid X but no intein insertion, and 3) the remaining unique sequences in the group that were not selected in step 1), for example, those remaining in SEQ ID NOS: 1233-1512, can be selected as the test set. The support vectors are then trained using the same method as for the total prediction, and these support vectors are then used to score the test set, which consists of positive values of the known insertion site cassettes, and negative values of all other non-insertion site cassettes selected from the exteins (SEQ ID NOS: 673-1232) with cysteine, threonine, or serine at the 0 position.

The scores for the collection of sites for each protein are then compared and the insertion sites are ranked according to their scores. To create a metric for comparison, each intein insertion site can be assigned a number that is calculated as the ratio of the number of sites with a lower SVM score than the insertion site (L), divided by the number of all sites in the test set minus one (Nn), or L/Nn. A metric of 1 would mean that the insertion site has a higher number than all other sites, while a metric of 0 would mean that it has a lower number than all other sites. This process may be repeated 25 times for each size training set, with each run being based upon a random selection of insertion site cassettes from the SEQ ID NOS: 1233-1512, and the corresponding true negative insertion sites selected from the corresponding SEQ ID NOS: 673-1232, to be used for training and testing. Table 1, below, shows the metrics for known intein insertion sites using this training and testing procedure. The average metric for the known intein insertion sites and the standard deviations for each size training set in Table 1 are based on the preferred embodiment including training and test set sequences selected from SEQ ID NOS: 673-1512. For training sets of size 25 or higher, on average the intein insertion site has a metric of 0.75. This was shown to be statistically significant, with an approximate p-value of $10^{-10}$ for a training set of 150 insertion site cassettes. Potential intein insertions sites for any target protein can be screened through the SVM to predict, based on local sequence characteristics, insertion sites that can be used to modify the activity of the target protein. In an embodiment, candidate insertion sites with a rank of 0.75 or higher are chosen as the site to insert an intein.

TABLE 1

| Training Set Size | Average Metric | Std. Dev. | Number of SV |
|---|---|---|---|
| 1 | 0.57 | 0.068 | 3 |
| 25 | 0.73 | 0.032 | 75 |
| 50 | 0.74 | 0.031 | 150 |
| 75 | 0.75 | 0.045 | 225 |
| 100 | 0.75 | 0.048 | 300 |
| 125 | 0.77 | 0.054 | 375 |
| 150 | 0.75 | 0.052 | 450 |
| 175 | 0.77 | 0.062 | 525 |
| 200 | 0.76 | 0.071 | 600 |
| 225 | 0.77 | 0.070 | 675 |
| 250 | 0.86 | 0.133 | 750 |

A set of preferred NNNXNN intein insertion cassettes include those having the sequence of GGKCGG, GGKSGG, GGKTGG, PGATSP, PGATVP, GAKSLG, PGATSL, PGASPL, PGATGP, AQRSLG, NQPSIV, NQASIV, PNMSSA, GNHSSG, PSHSAY, SLMSSC, TNTSNY, IDTSRN, PSTSAY, QIKSLG, FETCNY, AVLSVN, LVYSAH, AGYSSA, MWGTLR, LSASSY, FAQTQI, GGRSFV, SFVCGF, GFGSNP, NPPTRP, HHRSSS, HRSSSC, RSSSCP, DWNTFN, TFNSPD, DDRSDY, EVATDY, NQV-TEL, SSVTFW, LRESVW, RFHTLV, DLSSVT, DNHTWL, DYNTEV, LDVSLY, HYNSIV, ADLSSV, NIITEL, GHQTHI, MRNSPW, RFHTLV, DYNTDD, DKYSWL, LDMSIY, HNQTPT, DIKSWD, WGISDK, SGATDL, YYYSWW, SWWSDG, NFGTYD, GKTTRV, NAPSID, GTQTFD, QYWSVR, IVATEG, GYFSSG, NGNSYL, YGWTRN, YDPSSG, LGKTTR, YFSSGY, IDHTDS, SWSTNE, HTDSWS, NEITIN, DSWSTN, LDQSYV, EDP-TIT, SYVTGY, PWGSNS, GSNSFI, TPGSGG, TNYSHP, DGMSYL, PQKCYI, DLISLM, LMSSCM, AGSSQA, AGHSAW, GIATNT, ATNTSN, CDPSGR, PQGTWF, VIDTSR, QGLTSL, SGQSAL, NGDSYW, SGDTGG, GVQSYN, LVYSAH, EFGTTL, FQWTFW, TFWSWN, NPDSGD, GYQSSG, IVESWG, GWSTNP, NLGTID, TGNTTM, NGNSYL, YGWSTN, YQSSGS, SNASGT, or DGGTYD (SEQ ID NOS: 1513-1628, respectively).

B) The Distance of the Insertion Site to the Active Site Residues

Although an intein insertion at any point in a protein is contemplated, an intein insertion site can be selected to be close to the active site of the protein. As shown in FIG. 1, it was discovered that intein insertion sites within 25 angstroms of the active site are more common than those farther away. In FIG. 1, the distance between the insertion site and the active site is measured from i) the atom in the insertion site amino acid that is closest to the active site to ii) the atom in the active site that is closest to the insertion site amino acid. An intein may be inserted at a position that is less than or equal to 25, 24, 23, 22, 21, 20, 19, 18, 17, 16, 15, 14, 13, 12, 11, 10, 9, 8, 7, 6, 5, 4, 3, 2, or 1 angstroms away from the active site. In an embodiment, an intein insertion site is located at 10 angstroms or less from the active site of the target protein. As used herein, "within 10 angstroms" means 10 angstroms or less. The insertion site can be separated from the active site in the primary or secondary structure of the protein and the distance is measured through physical distance, rather than number of amino acids or secondary structure landmarks. To determine the distance of the insertion site residue to the active site, protein characteristics may be obtained through reference to published data or crystallographic, nuclear magnetic resonance, or homology models. Homology models can be constructed using Swissprot (SWISS-MODEL and the Swiss-PdbViewer: An environment for comparative protein modeling. Guex, N. and Peitsch, M. C. (1997) *Electrophoresis* 18, 2714-2723, which is incorporated by reference herein as if fully set forth) with default parameters. Active site residues can be identified by reference to literature regarding a specific protein, or by using the annotation of active site positions as described by the NCBI genPept files (Database resources of the National Center for Biotechnology Information. David L. Wheeler, Tanya Barrett, Dennis A. Benson, Stephen H. Bryant, Kathi Canese, Vyacheslav Chetvernin, Deanna M. Church, Michael DiCuccio, Ron Edgar, Scott Federhen, Lewis Y. Geer, Yuri Kapustin, Oleg Khovayko, David Landsman, David J. Lipman, Thomas L. Madden, Donna R. Maglott, James Ostell, Vadim Miller, Kim D. Pruitt, Gregory D. Schuler, Edwin Sequeira, Steven T. Sherry, Karl Sirotkin, Alexandre Souvorov, Grigory Starchenko, Roman L. Tatusov, Tatiana A. Tatusova, Lukas Wagner, and Eugene Yaschenko (2007) Nucl. Acids Res. 2007 35: D5-D12, which is incorporated by reference herein as if fully set forth), the Catalytic Site Atlas database (The Catalytic Site Atlas: a resource of catalytic sites and residues identified in enzymes using structural data. Craig T. Porter, Gail J. Bartlett, and Janet M. Thornton (2004) Nucl. Acids. Res. 32: D129-D133; Analysis of Catalytic Residues in Enzyme Active Sites. Gail J. Bartlett, Craig T. Porter, Neera Borkakoti, and Janet M. Thornton (2002) J Mol Biol 324:105-121; Using a Library of Structural Templates to Recognise Catalytic Sites and Explore their Evolution in Homologous Families. James W. Torrance, Gail J. Bartlett, Craig T. Porter, Janet M. Thornton (2005) J Mol. Biol. 347:565-81, which are incorporated by reference herein as if fully set forth), and other sources of active site information. Intein insertions at or near other protein sites, such as but not limited to allosteric affector sites, are also contemplated. An insertion site at or near an other protein site is not limited to but can be less than or equal to 25, 24, 23, 22, 21, 20, 19, 18, 17, 16, 15, 14, 13, 12, 11, 10, 9, 8, 7, 6, 5, 4, 3, 2, or 1 angstroms away from the other site.

C) The Proximity of the Insertion Site to a Local Secondary Structure

Intein insertion sites may occur within any type of local secondary structure. In an embodiment, the intein insertion site is near a loop-β sheet junction or an α-helix junction. As used in this context, "near" means that the insertion site is within ten amino acids from a loop-β sheet junction or an α-helix junction. As used herein, the insertion site "within ten amino acids" of a loop-β sheet or a loop α-helix junction means that the insertion site is located before the amino acid that is 10, 9, 8, 7, 6, 5, 4, 3, 2, or 1 amino acids away or at the loop-3 sheet or loop α-helix junction. An intein may be inserted within 2 amino acids of a loop-β-sheet junction or within 2 amino acids of a loop-α-helix junction. As used herein, "within 2 amino acids" means that the intein is inserted before an amino acid that is 2 or 1 amino acid away from or at the loop-3 sheet or loop α-helix junction. Additional secondary structures where an intein can be inserted include, but are not limited to, at or near the middle of a β-sheet, at or near the middle of a of α-helix, or at or near the middle of a loop.

Summary of Intein Insertion Site Prediction

Based on one or more of A) the local sequence as described by the SVM, B) the distance of the site to the active site residues, and C) the proximity of the insertion site to a local secondary structure (e.g., a loop-β-sheet junction or a loop-α-helix junction), intein insertion sites that can be used to control protein activity can be predicted and then tested experimentally. The SVM model can be used to predict an insertion site that can be used to control protein activity on-average within the top 25% of all sites. Intein insertion sites may be located at or within 10 angstroms from active site residues. The local secondary structure of intein insertion sites may be at or near the junction of loops with either β-sheets or α-helices.

After predicting an insertions site, the protein can be modified with an intein and screened. The screening can include functional assays to determine if the intein modified protein has a permissive, non-permissive, condition-sensitive permissive, temperature-sensitive permissive, or switching phenotype. The screening can include physical assays to determine if the intein in the intein modified protein spliced, cleaved, or remained within the intein-modified protein upon construction or after exposure to induction conditions. Western blots can be used to determine if the intein in the intein modified protein spliced, cleaved, or remained within the intein-modified protein. A combination of functional and physical assays can be employed to determine if the intein modified protein is a condition-sensitive switcher splicer. The combination of functional and physical assays can be used to determine if the intein modified protein is a temperature-sensitive switcher splicer by constructing the protein, exposing it to an induction temperature and conducting the functional and physical assays.

An intein modified protein can be constructed without using the prediction method by inserting an intein prior any C/S/T position. The C/S/T position can be natural or introduced.

An intein modified protein encoding sequence can be mutated. The mutations can be carried out on the intein encoding sequences, the extein encoding sequences, or a combination thereof. Mutated intein modified proteins can then be constructed and screened by functional and/or physical assays.

In an embodiment, an isolated protein having a sequence with at least 70, 75, 80, 85, 90, 91, 92, 93, 94, 95, 96, 97, 98, 99, or 100% identity to a protein having the sequence of any one of SEQ ID NOS: 1629-1784 and 2059-2089 is provided. In an embodiment, the one or more proteins having less than 100% identity to its corresponding amino acid sequence of SEQ ID NOS: 1629-1784 and 2059-2089 is a variant of the referenced protein or amino acid. In an embodiment, an isolated protein, polypeptide, oligopeptide, or peptide having a sequence with at least 70, 75, 80, 85, 90, 91, 92, 93, 94, 95, 96, 97, 98, 99, or 100% identity to a protein having the sequence of any one of SEQ ID NOS: 1629-1784 and 2059-2089 along 6, 10 to 50, 10 to 100, 10 to 150, 10 to 300, 10 to 400, 10 to 500, 10 to 600, 10 to 700, 10 to 800, 10 to 900, or 10 to all amino acids of a protein having the sequence of any of one any one of SEQ ID NOS: 1629-1784 and 2059-2089 is provided. This list of sequence lengths encompasses every full length protein in SEQ ID NOS: 1629-1784 and 2059-2089 and every smaller length within the list, even for proteins that do not include over 900 amino acids. For example, the lengths of 6, 10 to 50, 10 to 100, 10 to 150, 10 to 300, 10 to 400, and 10 to all amino acids would apply to a sequence with 453 amino acids. A range of amino acid sequence lengths herein includes every length of amino sequence within the range, endpoints inclusive. The recited length of amino acids may start at any single position within a reference sequence where enough amino acids follow the single position to accommodate the recited length. The range of sequence lengths can be extended by increments of 10 to 100N amino acids, where N=an integer of ten or greater, for sequences of 1000 amino acids or larger. Identity can be measured by the Smith-Waterman algorithm (Smith T F, Waterman MS (1981), "Identification of Common Molecular Subsequences," *Journal of Molecular Biology* 147: 195-197, which is incorporated by reference in its entirety as if fully set forth.) Peptides, oligopeptides, or polypeptides having amino acid sequences less than the full length of any one of SEQ ID NOS: 1629-1784 and 2059-2089 can be used for a number of applications including but not limited to raising an antibody to detect an intein modified protein or a fragment thereof. The antibody can be used to detect whether an intein modified protein or fragment thereof is expressed in a plant, a plant tissue, a plant cell, or a plant sub-cellular region or compartment. An embodiment provides an antibody recognizing an epitope on an isolated amino acid sequence having at least 90% identity to 6, 10 to 50, 10 to 100, 10 to 150, 10 to 300, 10 to 400, 10 to 500, 10 to 600, 10 to 700, 10 to 800, 10 to 900, or 10 to all contiguous amino acid residues of a protein having the sequence of any of SEQ ID NOS: 1629-1784 and 2059-2089.

The skilled artisan will realize that variants of the above protein or amino acid sequences can be made by conservative amino acid substitutions, and variants of any of the above sequences with conserved amino acid changes are provided as further embodiments. Proteins with any of the above sequences but having synthetic or non-naturally occurring amino acid analogues (and/or peptide linkages) are included in the embodiments herein. A conservative amino acid substitution can be an amino acid substitution that does not alter the relative charge or size characteristics of the polypeptide in which the amino acid substitution is made. Amino acids are sometimes specified using the standard one letter code: Alanine (A), Serine (S), Threonine (T), Aspartic acid (D), Glutamic acid (E) Asparagine (N), Glutamine (Q), Arginine (R), Lysine (K), Isoleucine (I), Leucine (L), Methionine (M), Valine (V), Phenylalanine (F), Tyrosine (Y), Tryptophan (W), Proline (P), Glycine (G), Histidine (H), Cysteine (C). "Hydrophobic amino acids" refers to A, L, I, V, P, F, W, and M; "polar amino acids" refers to G, S, T, Y, C, N, and Q; and "charged amino acids" refers to D, E, H, K, and R. Conservative amino acid substitution can also include amino acid substitutions of those amino acids that are not critical for protein activity, or substitution of amino acids with other amino acids having similar properties (for example, acidic, basic, positively or negatively charged, polar or non-polar, hydrophobic, charged, et cetera) such that the substitutions of a critical amino acid does not substantially alter activity. The following six groups each contain amino acids that are conservative amino acid substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W). One of skill in the art will appreciate that the above-identified substitutions are not the only possible conservative substitutions. For example, in some instances one may regard all charged amino acids as conservative substitutions for each other whether they are positive or negative. In addition, individual substitutions, deletions or additions which alter, add or delete a single amino acid or a small percentage of amino acids in an encoded sequence can also be conservative amino acid substitutions. Conservative amino acid substitution tables providing functionally similar amino acids are well known in the art and conservative amino acid changes as known in the art are contemplated herein. Conservative nucleotide substitutions in a nucleic acid encoding an isolated protein are also contemplated in the present embodiments. Conservative nucleotide substitutions include but are not limited to those that affect a conservative amino acid substitution in the encoded amino acid sequence. In addition, degenerate conservative nucleotide substitutions can be made in a gene sequence by substituting a codon for an amino acid with a different codon for the same amino acid.

The isolated proteins, polypeptides, oligopeptides, or peptides and variants thereof can be prepared according to methods for preparing or altering polypeptide sequences, and their encoding nucleic acid sequences, known to one of ordinary skill in the art such as are found in common molecular biology references, for example, Molecular Cloning: A Laboratory Manual, J. Sambrook, et al., eds., Second Edition, Cold Spring Harbor Laboratory Press, Cold Spring Harbor, N.Y. (1989) or Current Protocols in Molecular Biology, F. M. Ausubel, et al., eds., John Wiley & Sons, Inc., New York, which are incorporated herein as if fully set forth. The isolated proteins, polypeptides, oligopeptides, or peptides may include natural amino acids, natural amino acid analogues, or synthetic amino acid analogues.

In an embodiment, an isolated nucleic acid, or the complement thereof, having a sequence encoding an amino acid sequence with at least 70, 75, 80, 85, 90, 91, 92, 93, 94, 95, 96, 97, 98, 99, or 100% identity to a protein having the sequence of any one of SEQ ID NOS: 1629-1784 and 2059-2089 is provided. In an embodiment, the nucleic acid encoding an amino acid sequence having less than 100% identity to the reference sequence encodes a variant of the reference sequence. In an embodiment, an isolated nucleic acid, polynucleotide, or oligonucleotide having a sequence encoding an amino acid sequence with at least 75, 80, 85, 90, 91, 92, 93, 94, 95, 96, 97, 98, 99, or 100% identity to a an amino acid sequence of any one of SEQ ID NOS: 1629-1784 and 2059-2089 along 6, 10 to 50, 10 to 100, 10 to 150, 10 to 300, 10 to 400, 10 to 500, 10 to 600, 10 to 700, 10 to 800, 10 to 900, or 10 to all amino acids of a protein having the sequence of any of one SEQ ID NOS: 1629-1784 and 2059-2089 is provided. In an embodiment, the complement of said isolated nucleic acid, polynucleotide, or oligonucleotide is provided. This list of sequence lengths encompasses every full length protein in SEQ ID NOS: 1629-1784 and 2059-2089 and every smaller length within the list, even for proteins that do not include over 900 amino acids. For example, the lengths of 6, 10 to 50, 10 to 100, 10 to 150, 10 to 300, 10 to 400, and 10 to all amino acids would apply to a sequence with 453 amino acids. The range of sequence lengths can be extended by increments of 10 to 100N amino acids, where N=an integer of ten or greater, for sequences of 1000 amino acids or larger. Identity can be measured by the Smith-Waterman algorithm (Smith T F, Waterman M S (1981), "Identification of Common Molecular Subsequences," *Journal of Molecular Biology* 147: 195-197, which is incorporated by reference in its entirety as if fully set forth).

In an embodiment, an isolated nucleic acid having a sequence that hybridizes to a nucleic acid having the sequence of any one of SEQ ID NOS: 1785-1923 and 2052-2058 or the complements thereof is provided. In an embodiment, the hybridization conditions can be low stringency. In an embodiment, the hybridization conditions can be moderate stringency. In an embodiment, the hybridization conditions can be high stringency. Examples of hybridization protocols and methods for optimization of hybridization protocols are described in the following books: Molecular Cloning, T. Maniatis, E. F. Fritsch, and J. Sambrook, Cold Spring Harbor Laboratory, 1982; and, Current Protocols in Molecular Biology, F. M. Ausubel, R. Brent, R. E. Kingston, D. D. Moore, J. G. Seidman, J. A. Smith, K. Struhl, Volume 1, John Wiley & Sons, 2000, which are incorporated by reference in their entirety as if fully set forth. By way of example, but not limitation, procedures for hybridization conditions of moderate stringency are as follows: filters containing DNA are pretreated for 2-4 h at 68° C. in a solution containing 6×SSC (Amresco, Inc., Solon, Ohio), 0.5% SDS (Amersco, Inc., Solon, Ohio), 5×Denhardt's solution (Amersco, Inc., Solon, Ohio), and 100 µg/mL denatured, salmon sperm DNA (Invitrogen Life Technologies, Inc., Carlsbad, Calif.). Approximately 0.2 mL of pretreatment solution are used per square centimeter of membrane used. Hybridizations are carried out in the same solution with the following modifications: 0.01 M EDTA (Amersco, Inc., Solon, Ohio), 100 µg/ml salmon sperm DNA, and $5-20 \times 10^6$ cpm $^{32}$P-labeled or fluorescently labeled probes can be used. Filters are incubated in hybridization mixture for 16-20 h at 68° C. and then washed for 15 minutes at room temperature (within five degrees of 25° C.) in a solution containing 2×SSC and 0.1% SDS, with gentle agitation. The wash solution is replaced with a solution containing 0.1×SSC and 0.5% SDS, and incubated an additional 2 h at 68° C., with gentle agitation. Filters are blotted dry and exposed for development in an imager or by autoradiography. If necessary, filters are washed for a third time and re-exposed for development. By way of example, but not limitation, low stringency refers to hybridizing conditions that employ low temperature for hybridization, for example, temperatures between 37° C. and 60° C. By way of example, but not limitation, high stringency refers to hybridizing conditions as set forth above but with modification to employ high temperatures, for example, hybridization temperatures over 68° C.

In an embodiment, an isolated nucleic acid, polynucleotide, or oligonucleotide encoding at least a portion of any of the amino acid sequences of SEQ ID NOS: 1629-1784 and 2059-2089 can be used as a hybridization probe or primer. In an embodiment, the complement of said isolated nucleic acid, polynucleotide or oligonucleotide may be used as a hybridization probe or primer. In an embodiment, an isolated nucleic acid having a sequence that hybridizes to at least a portion of a nucleic acid having the sequence of any one of SEQ ID NOS: 1785-1923 and 2052-2058 or the complement thereof may be used as a hybridization probe or primer. These isolated nucleic acids, polynucleotides, or oligonucleotides are not limited to but may have a length in the range from 10 to 100, 10 to 90, 10 to 80, 10 to 70, 10 to 60, 10 to 50, 10 to 40, 10 to 35, 10 to 30, 10 to 25, 10 to 20 or 10 to 15 nucleotides, or from 20 to 30 nucleotide, or be 25 nucleotides in length. A range of nucleotide sequence lengths recited herein includes every length of nucleotide sequence within the range, endpoints inclusive. The recited length of nucleotides may start at any single position within a reference sequence where enough nucleotides follow the single position to accommodate the recited length. In an embodiment, a hybridization probe or primer is 85 to 100%, 90 to 100%, 91 to 100%, 92 to 100%, 93 to 100%, 94 to 100%, 95 to 100%, 96 to 100%, 97 to 100%, 98 to 100%, 99 to 100%, or 100% complementary to a nucleic acid with the same length as the probe or primer and having a sequence chosen from a length of nucleotides corresponding to the probe or primer length within a nucleic acid encoding one of the proteins of SEQ ID NOS: 1629-1784 and 2059-2089 or the complement of said nucleic acid. In an embodiment, a hybridization probe or primer hybridizes along its length to a corresponding length of a nucleic acid encoding the sequence of one of SEQ ID NOS: 1629-1784 and 2059-2089 or the complement said nucleic acid. In an embodiment, hybridization can occur under conditions of low stringency. In an embodiment, hybridization can occur under conditions of moderate stringency. In an embodiment, hybridization can occur under conditions of high stringency.

The isolated nucleic acids, polynucleotides, or oligonucleotides of embodiments herein may include natural nucleotides, natural nucleotide analogues, or synthetic nucleotide analogues. Nucleic acids, polynucleotides, or oligonucleotides of embodiments herein may be any kind of nucleic acid including deoxyribonucleic acid (DNA), ribonucleic acid (RNA), or peptide nucleic acid (PNA). SEQ ID NOS: 1785-1923 are listed as a DNA sequences but RNA sequences where U replaces T in SEQ ID NOS: 1785-1923 are also contemplated as nucleic acids of embodiments herein.

Although non-labeled hybridization probes or primers can be used in the embodiments herein, the hybridization probes or primers may detectably labeled and could be used to detect, sequence, or synthesize nucleic acids. Exemplary labels include, but are not limited to, radionuclides, light-absorbing chemical moieties, dyes, and fluorescent moieties. The label may be a fluorescent moiety, such as 6-carboxyfluorescein (FAM), 6-carboxy-4,7,2',7'-tetrachlorofluorescein (TET), rhodamine, JOE (2,7-dimethoxy-4,5-dichloro-6-carboxyfluorescein), HEX (hexachloro-6-carboxyfluorescein), or VIC.

In an embodiment, an isolated nucleic acid, polynucleotide, or oligonucleotide encoding an intein modified protein, a variant of an intein modified protein, or a fragment of an intein modified protein is provided in an expression construct suitable for expression in a desired host. The fragment of an intein modified protein may include a portion of the intein modified protein that retains the activity of the intein modified protein. But the fragment may also have other utility such as but not limited to serving as an antigen to make antibody that can then be used to detect an intein-modified protein or fragment thereof in or extracted from a plant, plant tissue, plant cell, or plant subcellular region or compartment. The nucleic acid may include a sequence encoding an amino acid sequence with at least 70, 75, 80, 85, 90, 91, 92, 93, 94, 95, 96, 97, 98, 99, or 100% identity to a protein having the sequence of any one of SEQ ID NOS: 1629-1784 and 2059-2089. A fragment of the intein modified protein encoding nucleic acid in an expression construct may encode an amino acid sequence having 75, 80, 85, 90, 91, 92, 93, 94, 95, 96, 97, 98, 99, or 100% identity to a an amino acid sequence of any one of SEQ ID NOS: 1629-1784 and 2059-2089 along 6, 10 to 50, 10 to 100, 10 to 150, 10 to 300, 10 to 400, 10 to 500, 10 to 600, 10 to 700, 10 to 800, 10 to 900, or 10 to all amino acids of a protein having the sequence of any of one any one of SEQ ID NOS: 1629-1784 and 2059-2089. This list of sequence lengths encompasses every full length protein in SEQ ID NOS: 1629-1784 and 2059-2089 and every smaller length within the list, even for proteins that do not include over 900 amino acids. For example, the lengths of 6, 10 to 50, 10 to 100, 10 to 150, 10 to 300, 10 to 400, and 10 to all amino acids would apply to a sequence with 453 amino acids. The range of sequence lengths can be extended by increments of 10 to 100N amino acids, where N=an integer of ten or greater, for sequences of 1000 amino acids or larger. The nucleic acid may include a sequence that hybridizes to a nucleic acid having the sequence or complement thereof of one of SEQ ID NOS: 1785-1923 and 2052-2058. In an embodiment, hybridization can occur under conditions of low stringency. In an embodiment, hybridization can occur under conditions of moderate stringency. In an embodiment, hybridization can occur under conditions of high stringency.

The expression construct may be any suitable expression construct for expression of the intein modified protein or fragment thereof in a suitable host. An embodiment is the expression construct pAG2005 (SEQ ID NO: 1) or any expression construct having at least 90, 91, 92, 93, 94, 95, 96, 97, 98, 99, or 100% identity to the sequence of SEQ ID NO: 1. In a preferred embodiment, a nucleic acid encoding any of the proteins in the preceding paragraph or a fragment thereof is provided in pAG2005. The nucleic acid can be cloned into the KpnI and EcoRI sites in pAG2005 and under control of the rice ubiquitin promoter.

The isolated nucleic acids, polynucleotides, or oligonucleotides in an expression construct may be codon optimized for an expression host. The codon optimization may be but is not limited to codon optimization for a plant. The codon optimization may be for one of switchgrass, corn, miscanthus, sorghum, sugarcane, wheat, or rice.

Figure 2A:
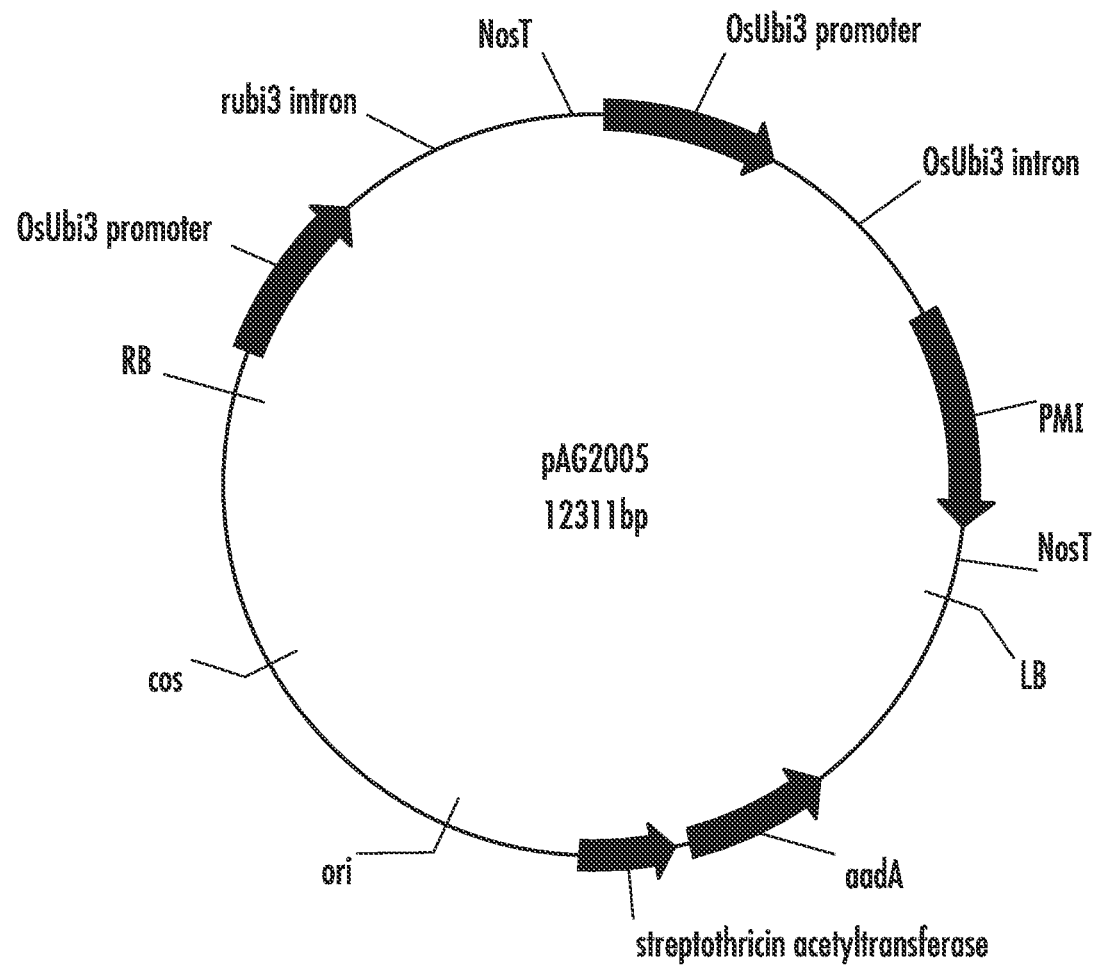
FIG. 2A illustrates a plant expression vector, which is designated pAG2005 (SEQ ID NO: 1).
Figure 2B:
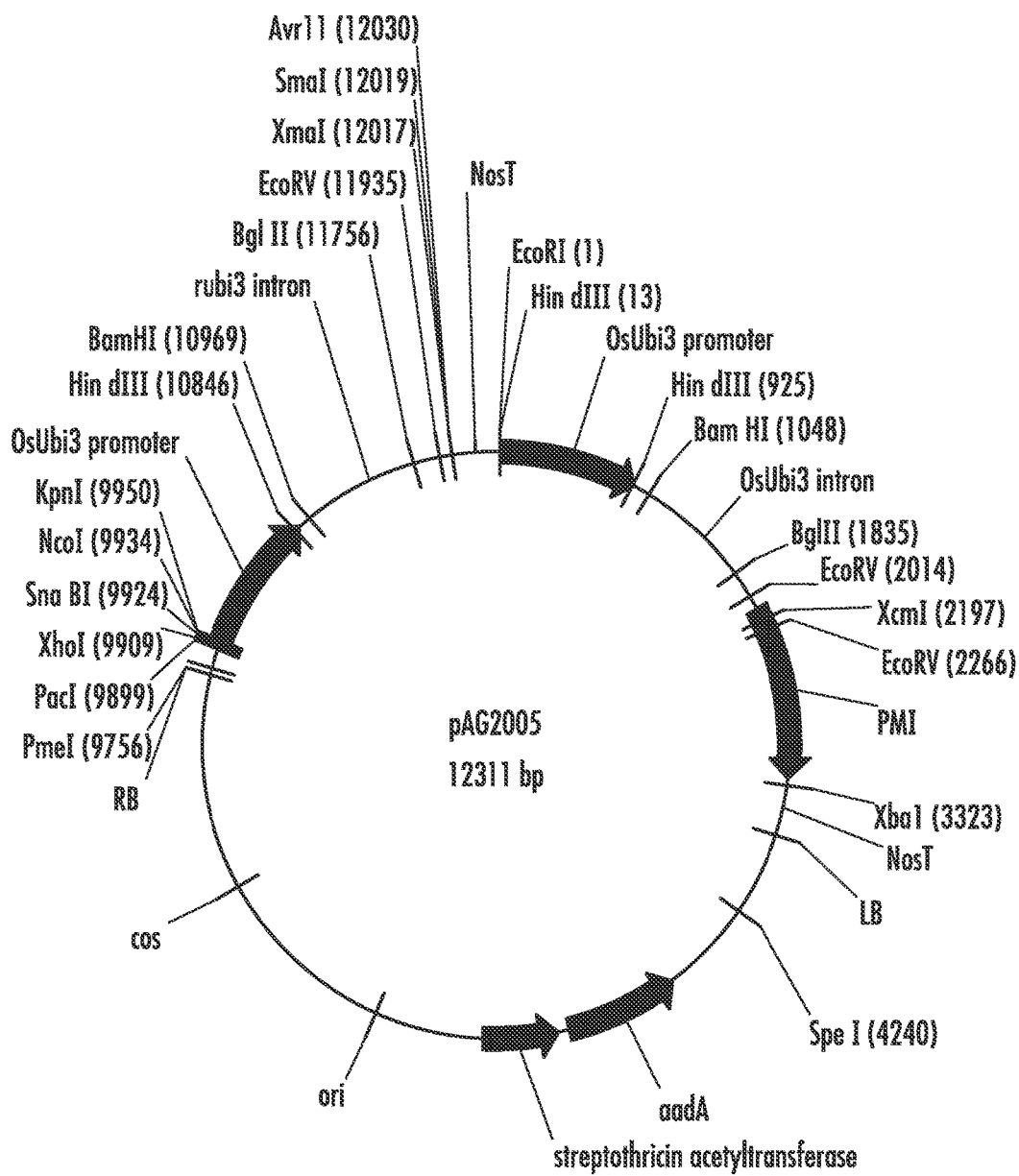
FIG. 2B illustrates pAG2005 (SEQ ID NO: 1) with greater detail.

The host for an expression construct having one or more of the nucleic acids, polynucleotides, or oligonucleotides may be a plant. The plant may be a monocotyledonous plant. The monocotyledonous plant can be but is not limited to switchgrass, corn, miscanthus, sorghum, sugarcane, wheat, or rice. The plant could be a dicotyledonous plant. The dicotyledonous plant can be but is not limited to soy bean, canola, poplar, willow, or rapeseed. The expression construct may be pAG2005 (SEQ ID NO: 1), which is illustrated in FIGS. 2A-2B. The nucleic acid in the expression construct can be operably linked to a promoter. The promoter may control the expression of the intein modified protein or fragment thereof and the promoter can be but is not limited to a plant ubiquitin promoter system, the maize ubiquitin promoter, a modified maize ubiquitin promoter that lacks one or more heat shock elements, rice ubiquitin promoter, rice actin 1 promoter, rice actin 2 promoter, gamma-zein promoter, glutelin promoter, maize PR-1 promoter, maize alcohol dehydrogenase 1 promoter, CaMV 19S promoter, CaMV 35S promoter, 35S-enhanced mas promoter, 35S minimal promoter, *Arabidopsis* PR-1 promoter, tobacco PR-1a promoter, opaline synthase promoter, soybean heat shock promoter, octopine synthase promoter, mannopine synthase promoter, a synthetic promoter, an alcohol inducible promoter, a tetracycline inducible promoter, a steroid inducible promoter, a hormone inducible promoter, a promoter based on the ecdysone receptor, a yeast copper responsive promoter, a metallothionein promoter, a heat regulated promoter, a cold inducible promoter, potato alpha-amylase promoter, a light regulated promoter, a maize chlorophyll a/b promoter, a dark and light-active Cab promoter, a tissue specific promoter, a root promoter, a seed specific promoter, or a constitutive promoter. The promoter could be a constitutive or inducible promoter and may be the rice ubiquitin, maize ubiquitin, gamma zein, glutelin, or rice actin promoter. The nucleic acid can be provided in the pAG2005 operably linked to the rice uniquitin promoter, and the construct can be provided in switchgrass, corn, miscanthus, sorghum, sugarcane, wheat, or rice. The nucleic acid can be cloned into the KpnI and EcoRI sites in pAG2005 and under control of the rice ubiquitin promoter. In an embodiment, if the nucleic acid in any of the above expression constructs encodes an amino acid sequence having less than 100% identity to any one of SEQ ID NOS: 1629-1784 and 2059-2089, it encodes a variant of the amino acid sequence.

Referring to FIGS. 2A to 2B, pAG2005 (SEQ ID NO: 1) includes an *Oryza sativa* ubiquitin 3 gene promoter with the first intron (OsUbi3 promoter, nucleotides 12-2094), a sequence encoding phosphomannose isomerase enzyme used for selection of transformants (PMI, nucleotides 2104-3279), a left T-DNA border (LB, nucleotides 3674-3698), a ColE1 origin of replication (Ori, nucleotide 6970), a right T-DNA border (RB, nucleotides 9717-9741), a second OsUbi3 promoter with the first intron (nucleotides 9948-12015), and a Nos terminator (nucleotides 12035-12310), where the nucleotide numbers are indexed relative to nucleotide 1 within the EcoRI sequence at the 5' end of the OsUbi3 promoter that drives PMI.

In an embodiment, a transgenic plant is provided with one or more of the isolated nucleic acids, polynucleotides, oligonucleotides, and/or expression constructs herein. The isolated nucleic acid, polynucleotide, oligonucleotide, and/or expression construct can be introduced into the plant by *Agrobacterium* mediated transformation or any other suitable method known in the art. *Agrobacterium*-mediated transformation of immature maize embryos may be performed as described in Negrotto et al., (2000) Plant Cell Reports 19: 798-803, which is incorporated by reference herein as if fully set forth.

Embodiments herein also include mutant inteins, which can be but are not limited to uses such as modifying a protein. The mutant inteins include but are not limited to those having at least 70, 75, 80, 85, 90, 91, 92, 93, 94, 95, 96, 97, 98, 99, or 100% identity to a protein having the sequence of any one of SEQ ID NOS: 92-103, or any one of the inteins contained in any one of SEQ ID NOS: 1675, 1678-1681, 1689, 1691, 1700-1708, and 1710. Embodiments also include a nucleic acid that encodes a mutant intein including but not limited to mutant inteins having at least 70, 75, 80, 85, 90, 91, 92, 93, 94, 95, 96, 97, 98, 99, or 100% identity to a protein having the sequence of any one of SEQ ID NOS: 92-103, or any of the inteins contained in any one of SEQ ID NOS: 1675, 1678-1681, 1689, 1691, 1700-1708, and 1710. Embodiments also include a nucleic acid that encodes a mutant intein, where the nucleic acid hybridizes to a nucleic acid, or the complement thereof, that encodes a protein having the sequence of one of SEQ ID NOS: 92-103, or any one of the inteins contained in any one of SEQ ID NOS: 1675, 1678-1681, 1689, 1691, 1700-1708, and 1710. In an embodiment, hybridization can occur under conditions of low stringency. In an embodiment, hybridization can occur under conditions of moderate stringency. In an embodiment, hybridization can occur under conditions of high stringency. A mutant intein may be inducible to cleave and/or splice from a protein in which it is inserted. Induction conditions can include exposure of the intein to changes in physical or chemical conditions such as, but not limited to, changes in temperature, pH, concentration of splicing inhibitors, concentration of ligand, light, salt conditions, and pressure. The induction condition can be but is not limited to an elevated temperature. The elevated temperature can be within but is not limited to the range of 50-70° C., which includes the temperatures of 50° C. and 70° C. The elevated temperature can be greater than or equal to a temperature in integer increments within the range of 25-70° C. The elevated temperature can be greater than or equal to 50° C., 55° C., 59.9° C., 60° C., 65° C., or 70° C. An intein having at least 70, 75, 80, 85, 90, 91, 92, 93, 94, 95, 96, 97, 98, 99, or 100% identity to a protein having the sequence of SEQ ID NOS: 2, 3, 4-103, 113-392, or any one of the inteins contained in any one of SEQ ID NOS: 1675, 1678-1681, 1689, 1691, 1700-1708, and 1710 can be used to modify a protein, enzyme, cellulase, or xylanase. A nucleic acid that hybridizes to a nucleic acid encoding SEQ ID NOS: 92-103, or any one of the inteins in any one of SEQ ID NOS: 1675, 1678-1681, 1689, 1691, 1700-1708, and 1710 or the complement thereof may be used to modify a protein, enzyme, cellulase, or xylanase at the nucleic acid level. The intein sequence in each of SEQ ID NOS: 1675, 1678-1681, 1689, 1691, 1700-1708, and 1710 can be found by comparing each one of the sequences with the Tth intein sequence of SEQ ID NO: 91.

As described above, embodiments include amino acid sequences where one such sequence comprises 75, 80, 85, 90, 91, 92, 93, 94, 95, 96, 97, 98, 99, or 100% identity to an amino acid sequence of any one of SEQ ID NOS: 1629-1784 and 2059-2089 along 6, 10 to 50, 10 to 100, 10 to 150, 10 to 300, 10 to 400, 10 to 500, 10 to 600, 10 to 700, 10 to 800, 10 to 900, or 10 to all amino acids of a protein having the sequence of any of SEQ ID NOS: 1629-1784 and 2059-2089. Embodiments also include nucleic acids encoding said amino acid sequences, and antibodies recognizing epitopes on said amino acid sequences. A less than full length amino acid sequence may be selected from any portion of one of the sequences of SEQ ID NOS: 1629-1784 and 2059-2089 corresponding to the recited length of amino acids. A less than full length amino acid sequence may be selected from a portion of any one of SEQ ID NOS: 1629-1784 and 2059-2089 having an upstream intein-extein junction with the C-terminal residue of the N-extein and the N-terminal residue of the intein at any two adjacent positions therein. For example, positions 236-237 in each of SEQ ID NOS: 2059-2089 are the C-terminal residue of the N-extein and the N-terminal residue of the intein for each respective sequence, and a less than full length amino acid sequence selected from any one of SEQ ID NOS: 2059-2089 may include residues 236-237 at any two positions within the recited length. A less than full length amino acid sequence may be selected from a portion of any one of SEQ ID NOS: 1629-1784 and 2059-2089 having a downstream intein-extein junction with the C-terminal residue of the intein and the N-terminal residue of the C-extein at any two adjacent positions therein. For example, positions 372-373 in each of SEQ ID NOS: 2059-2089 are the C-terminal residue of the intein and the N-terminal residue of the C-extein for each respective sequence, and a less than full length amino acid sequence selected from any one of SEQ ID NOS: 2059-2089 may include residues 372-373 at any two positions within the recited length. A less than full length amino acid sequence may be selected from a portion of any one of SEQ ID NOS: 1629-1784 and 2059-2089 where the portion selected includes at least one amino acid different than the native intein or native protein sequence at a position within the portion. For example, the following sequences include a mutation (indicated by "/AAi#AAj" following the sequence ID) relative to the base sequence (SEQ ID NO: 2059): SEQ ID NO: 2060/P325V; SEQ ID NO: 2061/E3121; SEQ ID NO: 2062/L320R; SEQ ID NO: 2063/L145I; SEQ ID NO: 2063/G323V; SEQ ID NO: 2063/A656V; SEQ ID NO: 2064/A350R; SEQ ID NO: 2065/P346V; SEQ ID NO: 2066/L234A; SEQ ID NO: 2066/A656V; SEQ ID NO: 2067/N232K; SEQ ID NO: 2067/A656V; SEQ ID NO: 2068/E335K; SEQ ID NO: 2068/W338Y; SEQ ID NO: 2069/N232K; SEQ ID NO: 2069/A656V; SEQ ID NO: 2070/V235S; SEQ ID NO: 2070/A656V; SEQ ID NO: 2071/R233G; SEQ ID NO: 2071/A656V; SEQ ID NO: 2072/L337R; SEQ ID NO: 2072/A656V; SEQ ID NO: 2073/N232K; SEQ ID NO: 2073/A656V; SEQ ID NO: 2074/N232C; SEQ ID NO: 2074/A656V; SEQ ID NO: 2075/N232L; SEQ ID NO: 2075/A656V; SEQ ID NO: 2076/L234G; SEQ ID NO: 2076/A656V; SEQ ID NO: 2077/N232S; SEQ ID NO: 2077/A656V; SEQ ID NO: 2078/N232W; SEQ ID NO: 2078/A656V; SEQ ID NO: 2079/R233L; SEQ ID NO: 2079/A656V; SEQ ID NO: 2080/N232V; SEQ ID NO: 2080/A656V; SEQ ID NO: 2081/R233S; SEQ ID NO: 2081/A656V; SEQ ID NO: 2082/N232M; SEQ ID NO: 2082/A656V; SEQ ID NO: 2083/N232A; SEQ ID NO: 2083/A656V; SEQ ID NO: 2084/N232V; SEQ ID NO: 2084/A656V; SEQ ID NO: 2085/L337M; SEQ ID NO: 2086/N232S; SEQ ID NO: 2086/A656V; SEQ ID NO: 2087/V235G; SEQ ID NO: 2087/A656V; SEQ ID NO: 2088/D339V; SEQ ID NO: 2089/L145I; SEQ ID NO: 2089/G323V; and SEQ ID NO: 2089/A656V. A less than full length amino acid sequence selected from one of SEQ ID NOS: 2060-2089 may include one or more of the amino acid changes listed above with respect to SEQ ID NO: 2059. A less than full length amino acid sequence selected from any other sequence herein with one or more amino acid change relative to the native intein or native enzyme may be similarly selected. The relative position of the amino acid changes with respect to one another may be maintained if the less than full length amino acid sequence selected includes more than one amino acid change. But the change or changes may otherwise appear anywhere within the recited length of the less than full length amino acid sequence. A nucleic acid provided herein may encode any one of these less than full length amino acid sequences. A nucleic acid provided herein may be of any length described above and include sequences encoding at least one of an upstream intein-extein junction, a downstream intein-extein junction or a change in an intein modified protein compared to the native protein or native intein sequence. An antibody provided herein may recognize an epitope on any one of these less than full length amino acid sequences. The epitope may include an upstream intein-extein junction, a downstream intein-extein junction, one or more changes in the less than full length amino acid sequence relative to the native intein or native protein sequence, or any other sequence in the less than full length amino acid sequence.

Any single embodiment herein may be supplemented with one or more element from any one or more other embodiment herein.

EXAMPLES

The following non-limiting examples are provided to illustrate particular embodiments. The embodiments throughout may be supplemented with one or more detail from any one or more example below.

Example 1—Intein Insertion Site Prediction

The use of A) the local sequence as predicted by an SVM, B) the distance of the site to the active site residues, or C) the proximity of the insertion site to a local secondary structure (e.g., the end of an alpha-helix or beta-sheet) allowed prediction of the insertions sites in the following xylanases and cellulases: The *Bacillus* sp. NG-27 xylanase (accession number O30700 (SEQ ID NO: 106)); the *Clostridium stercorarium* xynB xylanase (accession number P40942 (SEQ ID NO: 108)); the *Thermomyces lanuginosus* xynA xylanase (accession number O43097 (SEQ ID NO: 107)); the *Dictyoglomus thermophilum* xynB xylanase (accession number P77853 (SEQ ID NO: 104)); the *Clostridium thermocellum* celK cellulase (accession number O68438 (SEQ ID NO: 109)); the *Thermomonospora fusca* celB cellulase (accession number P26222 (SEQ ID NO: 110)); the *Acidothermus cellulolyticus* cellulase (accession number P54583 (SEQ ID NO: 111)); and the *Nasutitermes takasagoensis* cellulase (accession number O77044 (SEQ ID NO: 112)). For each of these xylanases and cellulases, the distance between each C/T/S site in the enzyme and its active site was calculated based upon the shortest distance between any atom in the C/T/S residue and any atom in any of the residues of the active site. Then, the SVM score of each NNNXNN local sequence cassette, where X is C/T/S, was obtained. The SVM was trained and utilized as described above using the intein insertion cassette sequences of SEQ ID NOS: 1233-1512. The validity of the SVM was tested using: 1) A random set of m (m ranged from 1 to 250) true positive training set sites with unique sequences selected from the intein containing protein library of SEQ ID NOS: 1233-1512; 2) true negatives including 3 other random cassettes from the extein sequences from which the true positive insertion cassettes were selected (SEQ ID NOS: 673-1232); 3) the remaining sequences from the intein insertion site cassettes of SEQ ID NOS: 1233-1512 as true positive test sets, where the known intein insertion sites were filtered to remove sequences in the training set; and 4) true negatives in the test set selected from other C/S/T sites in the extein sequences (SEQ ID NOS: 673-1232). Each true negative in the training set included the same central amino acid X as the corresponding true positive, but there was no intein insertion at that true negative amino acid position.

Sites that were at or closer than 10 angstroms and/or had an SVM score of greater than 0 were included for further analysis. Sites that scored high on the SVM score but were further than 20 angstroms were excluded. Next the secondary structure of all of the candidate site was determined and sites that were located at loop-(α-helix or β-sheet) junctions are prioritized. Sites that were located in long surface loops, that were not immediately adjacent to the active site, or sites that were in the core of the protein were also excluded. A list of such predicted insertion sites is shown in Table 2, below.

TABLE 2

| Enzyme | Predicted Insertion Sites |
| --- | --- |
| O30700 (SEQ ID NO: 106) | T309, T360, S215, T137, S358, T369, T250, S314, S95, S357 |
| P40942 (SEQ ID NO: 108) | T292, T263, S198, T122, T233, S350, S297, T129, S179, S346 |
| O43097 (SEQ ID NO: 107) | T134, S47, S50, T126, T152, S158, T164, S170, T208, S213, S103, T111, S130, T151, S214 |
| O68438 (SEQ ID NO: 109) | T788, T793, S790, T797, S792, S723, T759, T726, S680, S682, S547, S298, S712, C783 |
| P26222 (SEQ ID NO: 110) | S43, S115, S151, S154, S155, S180, S191, T217, T219, S220, S251, S266, T71, T250 |
| P54583 (SEQ ID NO: 111) | T133, S165, S251, T369, S246, S277, T326, T358, T361, S366 |
| P77853 (SEQ ID NO: 104) | S212, S158, S124, T113, T199, T52, S104, S112, S213, S35, T134, T145 |
| O77044 (SEQ ID NO: 112) | T356, S406, S363, S364, C348, S362, T303, S345, S379, S352, T376, S84, S325, T415 |

Example 2—Xylanase Cloning, Expression, and Activity Assays

Figure 35:
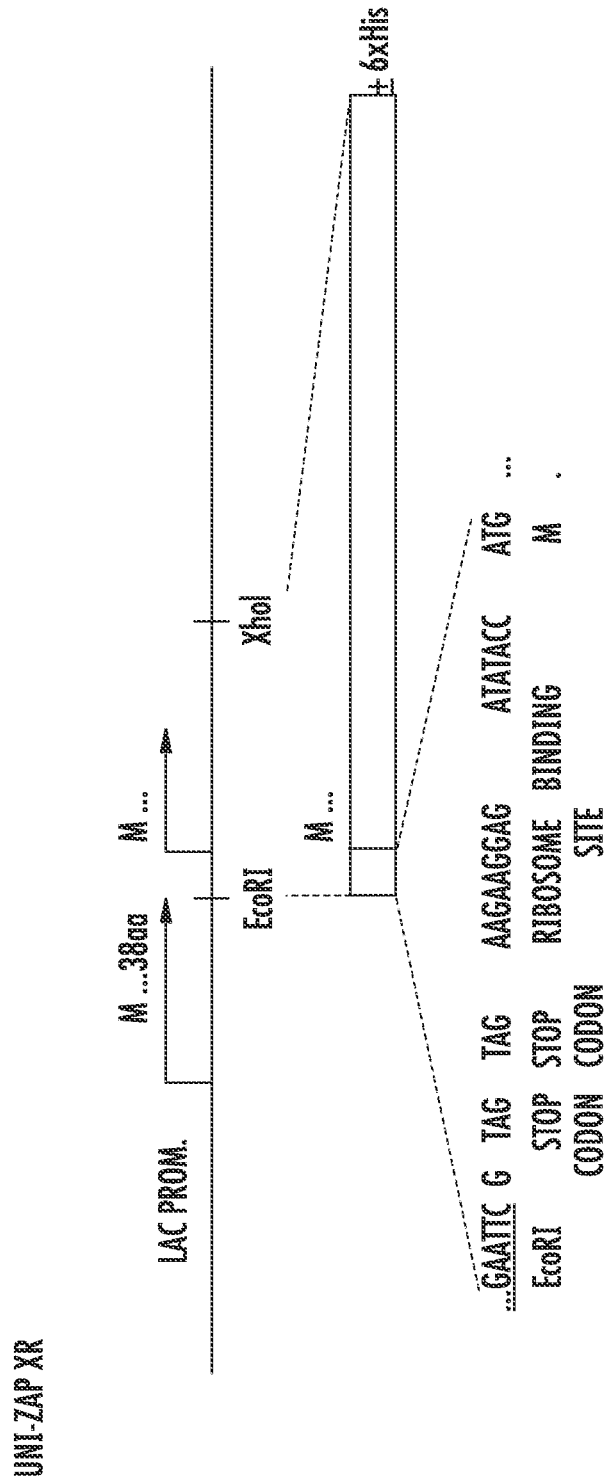
FIG. 35 illustrates the expression cassette in the λ ZAP® II vector.

Wild type xylanases were cloned for expression in the lambda phage and *E. coli* screening systems. The nucleic acids coding for nine xylanases were PCR amplified with or without a 6 His-tag attached to the carboxy terminal (referred to herein also as the "C-terminal") encoding sequence. These xylanases were the uncultured bacterium GH11 xylanase (accession number EU591743 (SEQ ID NO: 1924)), the *Bacillus* sp. NG-27 xylanase (accession number O30700 (SEQ ID NO: 106)), the *Thermomyces lanuginosus* xynA xylanase (accession number O43097 (SEQ ID NO: 107)), the *Clostridium stercorarium* xynA xylanase (accession number P33558 (SEQ ID NO: 1925)), the *Clostridium thermocellum* xynY xylanase (accession number P51584 (SEQ ID NO: 105)), the *Dictyoglomus thermophilum* xynB xylanase (accession number P77853 (SEQ ID NO: 104)), the *Clostridium stercorarium* xynB xylanase (accession number P40942 (SEQ ID NO: 108)), the *Erwinia chrysanthemi* xylanase (accession number Q46961 (SEQ ID NO: 1926)), and the *Thermotoga* sp. xynA xylanase (accession number Q60044 (SEQ ID NO: 1927)). The PCR products were EcoRI/XhoI digested (37° C. for one hr), column purified (MinElute PCR purification kit, Qiagen), and ligated (4° C. for at least 40 hours or 12° C. for at least 12 hours) into a predigested lambda ZAP® II vector (Stratagene). The expression cassette in the λ ZAP® II vector is illustrated in FIG. 35 with a gene of interest represented by the gray box. Once the enzyme genes were ligated into the predigested vector, the vectors containing the enzyme genes were packaged into lambda phage (room temperature for 2 hr) with phage packaging extract (Stratagene). The recombinant phage were used to infect XL1-Blue MRF' *E. coli* cells (Stratagene) and plated out on NZY agar plates (described in the ZAP®-cDNA Gigapack III Gold Cloning Kit, Stratagene) containing 0.2% AZCL-xylan substrate (Megazyme). NZY agar plates include 10 g of NZ amine (casein hydrolysate), 5 g NaCl, 2 g $MgSO_4*7H_2O$, 5 g yeast extract, and 15 g agar per liter, pH adjusted to 7.5 with NaOH, and are sterilized in an autoclave as described by the vender (Stratagene). AZCL-xylan substrate (Megazyme) includes azurine-crosslinked xylan, which is hydrolyzed to release dye and yield a blue color. After overnight incubation at 37° C., plates were visually inspected for the development of blue color in and around phage plaques. Xylanase activity was scored as active or inactive based on the ability to hydrolyze the AZCL-xylan substrate and thereby develop a blue color in and around the phage plaque. Selected plaques were confirmed by PCR to contain the subject xylanase gene and replated on NZY agar plates containing 0.2% AZCL-xylan to confirm the xylanase enzymatic activity of the phage plaque.

Each xylanase-expressing phage isolate was amplified in XL1-Blue MRF' *E. coli* cells to generate high titer phage lysate, which was used in a second infection of XL1-Blue MRF' *E. coli* cells (Stratagene) in the presence of Isopropyl β-D-1-thiogalactopyranoside (IPTG, Dioxane free, 99% pure; available from Research Products International, Corp.) to induce xylanase expression. Aliquots of individual lysates were incubated at different temperatures ranging from 4° C. to 70° C. for up to four hours, and then cooled at 4° C. for at least two hours. Xylanase activity from each lysate was measured either by Enzchek® kit (Invitrogen™) or by adding AZCL-xylan substrate to 0.2% and incubation at 37° C. or 70° C. for 4 hrs.

Xylanase activity was compared on NZY agar plates containing AZCL-xylan and in liquid assays. P77853 gave the strongest activity with or without C-terminal His-tag, followed by P51584, O43097 and O30700 on NZY agar plates supplemented with AZCL-xylan substrate. In all cases, the 6 His-tag suppressed at least some xylanase activity.

Example 3—Insertion of Inteins into Xylanases

Several inteins were inserted into a subset of the predicted sites, as set forth in Table 2, using a PCR approach. First, three pieces of DNA, "N" (for amino terminal or N-extein fragment) and "C" (for carboxy terminal or C-extein fragment) from a xylanase, and "I" (for intein) from an intein, were generated by PCR separately (Phusion™ Taq polymerase (New England Biolabs), following manufacturer's procedure). The intein fragment, I, was amplified so that it would have a 20 nucleotide overlap with the C-terminus of the N xylanase PCR fragment, and a 20 nucleotide overlapping region with N-terminus of the C xylanase PCR fragment. N, I, and C fragments were then assembled into a contiguous gene encoding an intein-modified enzyme, using a two step PCR (Accumprime™ Taq polymerase Pfx (Invitrogen)). As used herein, "NIC" represents the fusion of the N-terminal DNA fragment of the xylanase to the desired intein, which is also fused to the C-terminal DNA fragment of the xylanase. Although "NIC" is used in the context of an intein modified xylanase in this example, "NIC" can refer to the N-extein, intein, and C-extein contiguous sequence for any intein modified protein. A naming convention for the different constructs was adopted that follows the following format: (Target Enzyme)-(Intein)-(Insertion Site)-(Mutant Number); for example the Tth intein inserted into P77853 at S158 would be named P77853-Tth-S158. Likewise the Tth intein inserted into P77853 at T134 would be named P77853-Tth-T134. Mutants of either intein modified enzyme would then be named sequentially, with additional dashes; for example P77853-Tth-S158-1, P77853-Tth-S158-2, P77853-Tth-S158-3, P77853-Tth-S158-4, etc.

Generally, the first step in NIC assembly uses 100 ng each of N, I and C encoding nucleic acids in a master mix containing 1× buffer PCR reaction buffer, 200 μM of each dNTP, and 1 unit Pfx Taq polymerase in 12.5 μL with one cycle at 95° C. for two minutes, followed by five three-step thermal cycles of 95° C. for 20 seconds, 45° C. for one minute, and 68° C. for two minutes (alternatively three minutes may be used for longer genes), followed by a final PCR extension at 68° C. for 15 minutes. The second step is NIC amplification, where the master mix containing the assembled NIC is PCR amplified using 0.15 μM primers that hybridize to the 5' and 3' end of the assembled NIC DNA. The thermal cycle used in the second step uses one cycle at 95° C. for two minutes, followed by 27 three-step thermal cycles of 95° C. for 20 seconds, 58° C. for 30 seconds, and 68° C. for three minutes, followed by a final PCR extension at 68° C. for 15 minutes.

Assembled NIC genes, prepared as described above, were gel purified using a QIAquick Gel Extraction kit (Qiagen) and digested with EcoRI and XhoI (New England Biolabs), gel purified using a QIAquick Gel Extraction kit (Qiagen) and ligated with precut lambda ZAP® II vector (Stratagene) following the procedure set forth in example 2, above.

Products were plated on NZY agar plates containing 0.2% AZCL-xylan substrate, and the xylanase activity of the plaques was scored after overnight incubation at 37° C. The plates were then incubated for up to four hours at temperatures ranging from 37° C. to 70° C., and xylanase activity was scored for each plaque again. Based on the activity scores following the overnight incubation and the second incubation, each plaque was assigned a phenotype. Plaques that developed a blue color after the overnight incubation at 37° C. remained blue following the second incubation at an elevated temperature and were scored as permissive. Plaques that were inactive and did not develop a blue color following the overnight incubation at 37° C., but did develop a blue color following the second incubation at an elevated temperature were scored as switching. Plaques that were inactive after the overnight incubation at 37° C. and following the second incubation at an elevated temperature were scored as non-permissive. Based on agar plate phenotype of the intein modified xylanase bearing an intein at a specific site, the respective intein insertion was classified as permissive (intein insertion does not interfere with protein function, or intein is spliced during the overnight incubation at 37° C.), non-permissive (intein insertion interferes with protein function at all conditions tested) or switching (xylanase activity is observed following the four hour incubation at high temperature, but activity is not observed following the overnight incubation at 37° C.).

Individual plaques were picked from plates corresponding to each insertion site and excised as phagemid following the manufacture's protocol (Stratagene). Briefly, the lambda ZAP® II vector is designed to enable simple, efficient in vivo excision and recirculization of any cloned insert inside of the lambda vector to form a phagemid containing the cloned insert. To excise cloned inserts into a phagemid, isolated plaques are transferred to a sterile microcentrifuge tube containing 500 µL of SM buffer (Stratagene) and 20 µL of chloroform (Sigma). The tube is vortexed to release the phage particles into the SM buffer. The tube is incubated for at least one hour at room temperature or overnight at 4° C. After incubation, previously prepared XL1-Blue MRF' (Stratagene) and SOLR™ (Stratagene) cells are centrifuged at 1000×g for several minutes. The pellets are resuspended in 25 ml of 10 mM MgSO$_4$ to an OD$_{600}$ of 1.0 (8×10$^8$ cells/ml) in 10 mM MgSO$_4$. Once the cells are resuspended, 200 µL of XL1-Blue MRF' cells at an OD$_{600}$ of 1.0, 250 µL of the desired isolated phage stock (containing >1×10$^5$ phage particles), and 1 µl of the ExAssist® (Stratagene) helper phage (>1×10$^6$ pfu/µL) are placed into a 15 mL polypropylene tube. The tube is incubated at 37° C. for 15 minutes to allow the phage to attach to the cells. After the incubation, 3 mL of LB broth with supplements are added and the mixture is incubated for 2.5-3 hours at 37° C. with shaking. The mixture is then heated at 65-70° C. for 20 minutes to lyse the lambda phage particles and the cells. Following the lysis, the cell debris is pelleted by centrifuging the tube for 15 minutes at 1000×g. The supernatant is decanted into a new sterile tube. This supernatant contains the excised phagemid as filamentous phage particles. To plate the excised phagemids, 200 µL of freshly grown SOLR™ cells (OD$_{600}$=1.0) are mixed with 100 µL of the phage supernatant in a 1.5-mL microcentrifuge tube. This mixture is incubated at 37° C. for 15 minutes and then 200 µL of the cell mixture is spread on LB-ampicillin agar plates (100 µg/mL) and incubated overnight at 37° C. The resulting colonies contain the excised phagemid. Each phagemid contains an ampicillin resistance marker to support growth in ampicillin containing medium. After confirmation by PCR and DNA sequencing, phagemid clones were cultured in auto induction media (also referred to herein as AIM, obtained as Overnight Express™ Instant TB Medium, and is available from Novagen) overnight. Cells were lysed with FastBreak™ lysis buffer (Promega) and assayed for splicing by western blot.

Intein modified xylanases were analyzed for plaque phenotype on NZY agar plates, and for precursor accumulation and mature xylanase accumulation using a modified western blot procedure (described below in Example 5). A Psp-pol intein (SEQ ID NO: 3) was inserted into P77853 at positions S112 (SEQ ID NO: 1696) and S124 (SEQ ID NO: 1697), which were predicted as insertion sites in Example 1 (above). The plaque phenotype of these positions was scored as permissive for S112, and non-permissive for S124. On the western blot, S112 accumulated some precursor intein modified xylanase and some mature xylanase. S124 accumulated primarily precursor intein modified xylanase. In addition to the predicted sites, the Psp-pol intein was also inserted into several other sites. Among the other sites tested, S63 (SEQ ID NO: 1692), S86 (SEQ ID NO: 1694), S95 (SEQ ID NO: 1695), and S178 (SEQ ID NO: 1698) produced plaques that were scored as switching phenotypes with the Psp-pol intein. On the western blot, these sites accumulated precursor intein modified xylanase when unheated, and also mature xylanase following heat treatment of the phage lysate at 70° C.

A Tag intein (SEQ ID NO: 90) was inserted into P77853 at positions S112, T113, S124, T134, T145, S158, and T199, which were predicted as insertion sites in Example 1 (above). Plaques expressing the P77853 intein modified xylanase with the Tag intein were scored according to their phenotype as follows: S112 (non-permissive), T113 (non-permissive), S124 (non-permissive), T134 (permissive), T145 (switcher), S158 (non-permissive), and T199 (non-permissive). Precursor Tag intein modified xylanase accumulated for the S112, T113, S124, T134, T145, S158, and T199 insertions; however, only the T145 and T199 accumulated mature xylanase. Other cleavage products were observed on the western blot at other insertion sites.

A Tth intein (SEQ ID NO: 91) was inserted into the P77853 xylanase at positions S112, T113, S124, T134, T145, S158, and T199, which were predicted as insertion sites in Example 1 (above). The plaque phenotype of these positions was scored as follows: S112 (permissive), S124 (switcher), T113 (non-permissive), T134 (switcher), S158 (switcher), T145 (non-permissive), and T199 (non-permissive). On the western blot, some precursor intein modified xylanase accumulation was detected for S112, S124, T113, T134, S158, T145, and T199 insertion sites. Mature xylanase was detected on the western blot for S112, S124, T113, S158, and T145.

Mini-Psp-Pol inteins mPspM1L4 (SEQ ID NO: 7) and mPspM5L5 (SEQ ID NO: 36) were inserted into in the P77853 xylanase at the S112 insertion site, which was predicted as insertion sites in Example 1 (above). Plaques expressing the P77853 intein modified xylanase containing either mPspM1L4 or mPspM5L5 were scored as non-permissive phenotypes when inserted at S112, and were not analyzed by western blot. Likewise mini-Psp-Pol inteins mPspM1L4 (SEQ ID NO: 7), mPspM1L7 (SEQ ID NO: 10), mPspM2L5 (SEQ ID NO: 15), mPspM4L3 (SEQ ID NO: 27), mPspM5L2 (SEQ ID NO: 33), mPspM5L5 (SEQ ID NO: 36), and mPspM7L3 (SEQ ID NO: 48) generated non-permissive plaque phenotypes when inserted into the P77853 xylanase at S67. In contrast, these same inteins (mPspM1L4 (SEQ ID NO: 7), mPspM1L7 (SEQ ID NO: 10), mPspM2L5 (SEQ ID NO: 15), mPspM4L3 (SEQ ID NO: 27), mPspM5L2 (SEQ ID NO: 33), mPspM5L5 (SEQ ID NO: 36), and mPspM7L3 (SEQ ID NO: 48)) generated permissive plaques when inserted into the P77853 xylanase at S95 and S178.

A Psp-Pol intein (SEQ ID NO: 3) was inserted into the O30700 xylanase at positions S215, S314, and S357, which were predicted in Example 1 (above). The plaque phenotype of the Psp-pol intein inserted at these positions was scored non-permissive for S215 and S314, but permissive for S357. In contrast, when the mini Psp-Pol inteins mPspM1L4 (SEQ ID NO: 7), and mPspM3L5 (SEQ ID NO: 22) were inserted into the same sites, S314 was scored as permissive, while S215 and S357 were scored as non-permissive.

A Tth intein (SEQ ID NO: 91) was inserted into the O30700 xylanase at positions S95, T137, S215, T250, S358, S314, and S357, which were predicted in Example 1 (above). The plaque phenotype for phage expressing the O30700 xylanase with the Tth intein inserted was scored as: S95 (permissive), T137 (non-permissive), S215 (non-permissive), T250 (non-permissive), S314 (permissive), S357 (non-permissive), and S358 (permissive).

A Mth intein (SEQ ID NO: 2) and Tag intein (SEQ ID NO: 90) were separately fused to the C-terminus of the O30700 xylanase in individual experiments and the resulting intein modified proteins were active after overnight incubation at 37° C., indicating that C-terminal fusion with the Mth and Tag inteins was permissive with O30700.

A Tth intein (SEQ ID NO: 91) was inserted into the O43097 xylanase at positions S47, S50, S103, T111, T126, S130, T134, T151, T152, S158, T164, S170, T208, S213, and S214, which were predicted in Example 1 (above). Phage plaques expressing the Tth intein modified O43097 xylanase were scored for phenotype as follows: S47 (permissive), T134 (non-permissive), T151 (non-permissive), T152 (non-permissive), S158 (non-permissive), T164 (non-permissive), S170 (non-permissive), T208 (non-permissive), S213 (permissive), S214 (permissive). In the western blot analysis, the Tth intein modified O43097 xylanase precursor was observed for insertion sites S47, S50, S103, T111, S130, T164, S213, and S214, and mature O43097 xylanase was observed for S47, S50, S103, 5213, and S214. Phage lysates from phage expressing the Tth intein modified O43097 xylanase at positions T126, T134, T152, S158 were not analyzed by western blot.

As shown above, inserting an intein at an insertion site predicted based on the method described herein may result in an intein modified protein that has a switching phenotype. But the method also leads to permissive candidates or non-permissive candidates that may or may not be cleaved or spliced. Further, intein insertion at sites other than those found by the method can result in a switching phenotype. The method, however, enriches the pool of candidates for insertion sites that are more likely to lead to a switching phenotype.

Example 4—Mutagenesis of Intein Modified Enzymes

Many different methods of protein mutagenesis exist in the art but as a non-limiting example, different specific strategies were used to generate variant intein modified enzymes, as presented below.

Random mutation was introduced into a xylanase, intein modified xylanase, or intein in the examples above using a Mutazyme® (Stratagene) mutagenesis kit. Each time a template DNA is amplified by the Mutazyme®, there is a certain probability that a mutation will be introduced in the newly synthesized DNA. In practice, mutation rates are achieved by varying the amount of template DNA and number of PCR cycles. The mutagenic PCR procedure herein was optimized to introduce 1-2 amino acid mutations per intein when modifying the whole cassette or the intein coding portion.

For whole cassette mutagenesis, five μg of phagemid NIC DNA was PCR amplified for 10 cycles using the GeneMorph® II Random Mutagenesis Kit (Stratagene) with M13 Forward and Reverse primers following manufacturer's protocol. Briefly, five μg of phagemid NIC DNA to be mutagenized is mixed with 1× buffer PCR reaction buffer, 200 μM of each dNTP, 0.15 μM primers complementary to the ends of the NIC DNA, and 2.5 units Mutazyme® II DNA polymerase in a 50 μL final volume and subjected to one cycle at 95° C. for two minutes, followed by 10 three-step thermal cycles of 95° C. for 20 seconds, 58° C. for 30 seconds, and 68° C. for three minutes (one minute per kilobase of template), followed by a final PCR extension at 68° C. for 15 minutes. The amplification step was followed by 10 cycles of PCR with cloning primers for each mutagenized NIC DNA using regular Taq polymerase. The Mutagenized NIC DNA library thus generated was gel purified using the QIAquick gel extraction kit (Qiagen), digested with EcoRI and XhoI (New England Biolabs), column purified with the MinElute PCR purification kit (Qiagen), ligated into ZAP® II vector (Stratagene), packaged in lambda phage, as described above, and plated out on NZY agar, as described above.

For intein mutagenesis, five μg of intein encoding plasmid DNA was PCR amplified for 10 cycles with intein end specific primers using the GeneMorph® II Mutagenesis kit (Stratagene) following the manufacturer's protocol. Briefly, five μg of intein DNA to be mutagenized is mixed with 1× buffer PCR reaction buffer, 200 μM of each dNTP, 0.15 μM intein end specific primers and 2.5 unit Mutazyme® II DNA polymerase in a 50 μL final volume and with one cycle at 95° C. for two minutes, followed by 10 three-step thermal cycles of 95° C. for 20 seconds, 58° C. for 30 seconds, and 68° C. for three minutes, followed by a final PCR extension at 68° C. for 15 minutes. The mutagenized intein library was then gel purified using the QIAquick gel extraction kit (Qiagen). Xylanase N-terminal and C-terminal fragments (N and C) were generated by PCR using regular Taq polymerase. A NIC DNA with wild type N and C and a mutagenized intein library, I, was assembled using the PCR procedure described above and cloned into ZAP® II vector for library screening on NZY agar plates as described above.

For intein mutagenesis, a synthetic mutagenesis library of the Tth intein (SEQ ID NO: 91) was also made. This library was designed so that every single amino acid substitution was present at least once at every position in the Tth intein. Once designed, the library was synthesized by Genscript. Xylanase N-terminal and C-terminal fragments (N and C) were generated by PCR using regular Taq polymerase. A NIC DNA with wild type N and C and the synthetic mutagenized Tth intein library, I, was assembled using the PCR procedure described above and cloned for library screening.

The following mutagenized libraries were created by these procedures:
1. A whole cassette mutagenized library where the cassette containing mini-Psp Pol intein mPspM1L4 inserted in P77853 at the S67 site was mutagenized;
2. an intein mutagenized library where the mutagenized mini-Psp Pol intein mPspM1L4 was inserted in P77853 at the S67 site;
3. an intein mutagenized library where a mixture of mutagenized mini-Psp Pol intein mPspM1L4, mPspM2L5, mPspM3L5, mPspM4L3, mPspM5L5, mPspM5L2, and mPspM7L3 was inserted in P77853 at the S67 site;
4. an intein mutagenized library where mutagenized mini-Psp Pol intein mPspM5L5 was inserted in P77853 at the 5112 site;
5. a whole cassette mutagenized library where the cassette containing the Tth intein inserted in P77853 at the T134 site was mutagenized;
6. an intein mutagenized library where the mutagenized Tth was inserted in P77853 at the T134 site;
7. an intein mutagenized library where the mutagenized Tth was inserted in P77853 at the S158 site; and
8. an intein mutagenized library where the mutagenized mini-Psp Pol intein mPspM3L5 was inserted in O30700 at the S106, S215, S295, S314, S357 or S358 sites.

Example 5—Screening of Intein Modified Enzyme Libraries

The mutagenized libraries were screened and candidates were isolated, purified, and confirmed. Individual libraries were titrated to measure the titer (plaque forming unit or pfu per μl) by serial dilution in SM buffer (SM buffer can be prepared by mixing 5.8 g of NaCl, 2.0 g of $MgSO_4$*$7H_2O$, 50.0 mL of 1 M Tris-HCl (pH 7.5), 5.0 mL of 2% (w/v) gelatin into a final volume of one liter and sterilizing in an autoclave) and plating out on NZY plates. For insertion sites that were scored with a non-permissive phenotype, such as mini-Psp Pol intein mPspM1L4 in S67 site and 5112 site of P77853, or various sites in O30700, high density phage titers were used in screening. Up to 10,000 pfu were plated out with 500 μL of XL1-Blue MRF' cells (OD600=0.5) on a 15 cm plate. For libraries derived from intein modified enzymes (for example, libraries made from the insertion of the Tth intein at sites T134 and S158 in the P77853) that had a switching phenotype, 2000 pfu were screened per plate for libraries.

Each library was plated out on agar plates and incubated at 37° C. overnight. Plaques with blue halos were marked representing permissive phenotype mutations. Plates then went through a heat treatment series (50° for 2 hrs and then 70° C. for 2 hrs) to induce phenotype expression of the candidate phage plaques. Individual plaques were picked and diffused into 500 ul SM buffer. Serial dilutions in SM buffer were made and used to infect XL1-Blue MRF' cells, which were then plated onto NZY plates. Plates were incubated overnight at 37° C. and then 70° C. for 2 hrs. Plaque phenotypes were confirmed following incubation at both temperatures.

More than 500 intein modified P77853 xylanase candidates have been isolated, purified and phenotype confirmed. Among them about 100 include a mini-Psp Pol intein insertion at site S67, 70 include a M5L5 intein insertion at site S112, 250 include a Tth intein insertion at site T134, and 75 include a Tth intein insertion at site S158. For O30700 xylanase, about 50 picks went through plaque purification, phenotype confirmation and confirmation by PCR.

Phenotype-confirmed candidates were individually excised into phagemid following procedure described above. Most candidates were analyzed by enzyme assay. Candidates showing temperature-sensitive switching activity were analyzed by western blot assay (splicing) and DNA sequence analysis.

Enzyme assays for xylanase activity were conducted as follows: 1) Cultures were inoculated from a single colony containing an excised phagemid and grown overnight in 1 mL of Luria Broth (Luria Broth, LB, can be made by mixing 10 g of NaCl, 10 g of bacto-tryptone, and 5 g of bacto-yeast extract into a final volume of one liter, then adjusting the pH to 7.0 using 5 N NaOH, and sterilizing in an autoclave) supplemented with 100 mg/L ampicillin (AMP, obtained from Sigma) at 37° C. and 300 RPM. 2) 50 μl of cells were transferred to 5 mL of Overnight Express™ Instant TB medium (also called autoinduction medium, herein, or AIM, and is available from Novagen) and grown overnight at 30° C. and 250 RPM. 3) The cultures were centrifuged at 3000 RPM for 15 min. 4) The supernatant was removed and the cell pellets were resuspended in 200 μl lysis buffer (the lysis buffer contains 1× FastBreak Lysis Buffer™ (Promega), 200 mM Sodium Phosphate pH 6.5, and 0.41 DNase/mL). 5) The lysate was mixed thoroughly and a 1:10 dilution of the lysate was made in 200 mM Sodium Phosphate pH 6.5. And 6) 100 μl of each dilution was used for the activity assays, which were conducted on samples that were either exposed to splicing induction conditions, such as a heat pretreatment, or unexposed to induction conditions.

For Pretreatment (PT) assays, lysate samples were distributed into aliquots of equal volume, which were incubated at 37° C. or 55° C. for 4 hr, then cooled on ice. 20 μl 0.2% finely grounded AZCL substrate was then added and the samples were mixed well. Reactions were allowed to proceed at 37° C. for at least one hour, but sometimes as long as overnight. Depending upon the intein modified enzyme, and its respective mature enzyme, reaction times, temperatures, conditions, and substrates could vary.

For No Pretreatment (NPT) assays, samples were distributed into aliquots of equal volume and mixed with 20 μl 0.2% finely grounded AZCL substrate. Reactions were allowed to proceed at 37° C. and 70° C. for up to 6 hr. Depending upon the intein modified enzyme, and its respective mature enzyme, reaction times, temperatures, conditions, and substrates could vary.

In either the Pretreatment (PT) or No Pretreatment (NPT) assays, after the reaction time was complete the samples were vortexed and then centrifuged at 4,000 RPM for 7 minutes. From each sample, 50 μl of supernatant was used to measure the absorbance at 590 nm, which is an indication of how active an enzyme or intein modified enzyme was in the sample. Absorbance measurements were made either on a Thermo Scientific Spectrophotometer, or on a BioTek Synergy™ Multi-mode microplate reader in 96 or 384 well round bottom assay plates. If necessary, the samples were centrifuged again to make sure no cellular debris was picked up, and 5× or 10× dilutions in 200 mM Sodium Phosphate pH 6.5 were made when necessary.

Western blot analysis of candidate mutant intein modified enzymes was conducted as follows: 1) A 5 ml AIM culture as grown overnight at 30° C. and 250 RPM and then centrifuged at 3000 RPM for 15 min. 2) The supernatant was removed and the pelleted cells were resuspend in 200 μl of lysis buffer (see above). 3) The lysate was mixed thoroughly and a 1:50 dilution was made using 1× phosphate buffered solution (PBS can be prepared by mixing 137 mmol NaCl, 2.7 mmol KCl, 4.3 mmol of $Na_2HPO_4$, and 1.47 mmol of KH2PO$_4$ in a final volume of one liter, adjusting the pH to 7.4 with 2N NaOH, and filter sterilizing the solution with a 0.22 micron filter), while the remaining unused sample were stored at −20° C. (a higher dilution may be required depending on expression levels and activities). 4) For each dilution, 50 μl of each dilution was transferred to a sterile centrifuge or PCR tube and heat treated in a 37° C. or 59° C. for 4 hours (the volume may vary depending on needs, but a minimum of 15-25 μl is recommended). 5) An equal volume of 2× loading buffer (2× loading buffer contains 62.5 mM Tris-Cl pH 6.8, 6M Urea, 10% glycerol, 2% SDS, 0.0125% bromophenol blue, and 5% BME) was added; 6) A Biotinylated ladder was prepared with equal volume of urea (the volume of ladder can be calculated by multiplying the number of gels to be used by 20 μl for an 18-well gel (Biorad), or by multiplying the number of gels to be used by 15 μl for a 26-well gel (Biorad)). 7) The samples were vortexed well and then loaded onto the gel (for an 18-well Biorad gel, 30 μl samples were loaded and for a 26-well Biorad gel, 20 μl samples were loaded). 8) The gel was run at 150-175V for 1 hr and then disassembled. 10) The gel was soaked in 1× Transfer (Towbin) Buffer (25 mM Tris base, 192 mM glycine, and 20% methanol) for 15 mM. 11) A Whatman-PVDF (dipped in methanol)-gel-Whatman sandwich was assembled and sample was transferred by electroblotting at 15V and at less than 600 mA for 1 hr. 12) The blot was removed and placed in blocking solution containing 2% BSA in TBST (50 mM Tris-HCl, 150 mM NaCl, 0.1% Tween-20). 13) The blot was retained in the blocking solution overnight at 4° C. 14) Blocking solution was decanted and a primary antibody solution (1% BSA in TBST with 1:2,000 of primary antibody that recognizes the enzyme and intein modified enzyme being detected) was added. 15) The blot was washed with TBST 5 times for 5 minutes for each wash. 16) A secondary antibody solution (1% bovine serum albumin (BSA) in TBST with 1:20,000 horseradish peroxidase (HRP) antibiotin and 1:5,000 HRP anti rabbit secondary) was added and the blot was washed with TBST 5 times for 5 minutes each. 17) The blot was immersed in 20 μl of SuperSignal® West Pico Chemiluminescent Substrate (Pierce) for 5 min and then developed in a G:Box™ gel imaging system (Syngene) using successive snapshots, 20× at 1 mM intervals under Chemi setting.

DNA sequencing was done by routine methods in the art.

About 40 candidates from library (1) (mini-psp Pol intein mPspM1L4 in P77853 at S67 site, whole cassette mutagenized) were generated and analyzed on western blot and by DNA sequencing. Over fifty percent of the candidates sequenced had a stop codon in the C-extein, right in or after the linker sequence between the substrate binding domain and the catalytic domain. Whole cassette mutagenesis tended to create a large number of candidates with truncated P77853 protein lacking the entire carbohydrate binding domain, at the S67 insertion site. While spliced mature xylanase was observed in a few candidates (m25, m30), more candidates only had cleavage product (such as m3).

Intein mutagenesis was more efficient in creating amino acid substitutions. With the mutagenic PCR conditions tested, an average of 4 amino acid substitutions were observed in mini-psp Pol candidates, at both the S67 and S112 sites of P77853. These mutations led to precursor cleavage but not intein splicing in most mini-psp Pol candidates.

The Tth intein rendered P77853 intein modified xylanases temperature-sensitive on the NZY agar plate, in an enzyme assay and for accumulation of spliced product on western blot. Based on this result, Tth intein modified xylanase candidates were characterized further.

In order to accurately measure the temperature-sensitive switching and splicing activity of a large number of candidates, the optimum switching conditions (temperature and time) of these candidates was determined. First, a few candidates were tested for effect of heat pretreatment induction conditions on xylanase activity. It was found that 55° C. for 4 hours was the best from the series of temperatures tested (30° C., 37° C., 45° C., 55° C., 70° C.) and times tested (0.5 hr, 1 hr, 2 hr, 3 hr, 4 hr, 6 hr and 20 hrs). Several candidates were tested at a much smaller increment of temperature around 55° C. for 4 hours. 59° C. was found to be the optimum temperature for all Tth candidates tested using these conditions.

FIGS. 3A to 3L illustrate western blot data for Tth intein modified P77853, where the intein is inserted at either serine 158 (S158), or threonine 134 (T134) of the P77853 enzyme. The agar plate phenotype is denoted for each sample at the top of the lane. The agar plate phenotypes are given as "SW" for a switcher phenotype, TSP for a temperature sensitive switcher splicer phenotype, and P for a permissive phenotype.

Figure 3A:
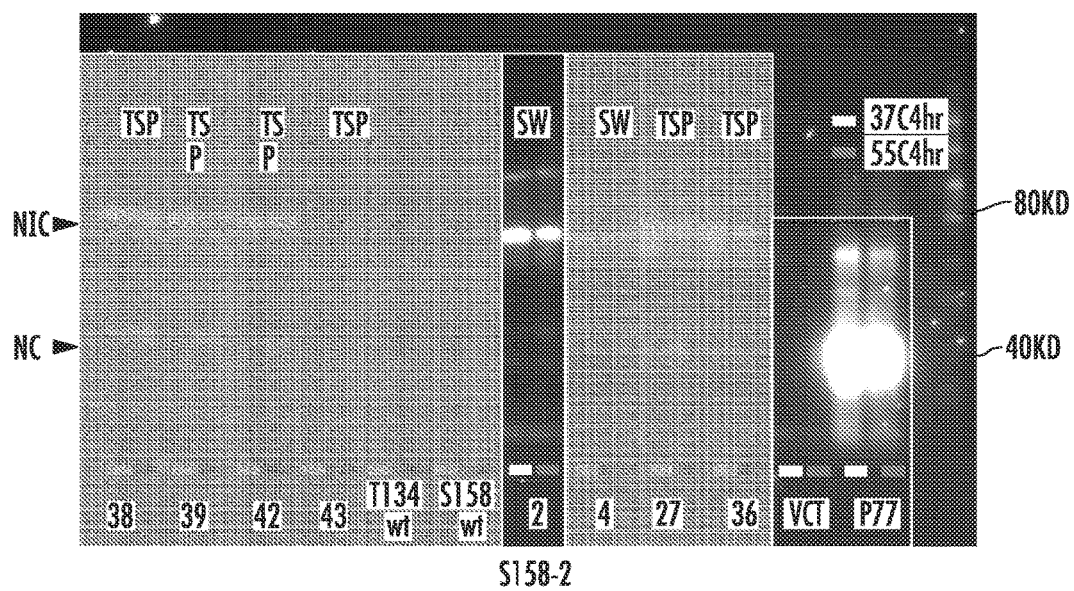
FIGS. 3A to 3L illustrate western blot data for Tth intein modified P77853, where the intein is inserted at either serine 158 (S158), or threonine 134 (T134) of the P77853 enzyme. In some of FIGS. 3A to 3L, parts of the western blot are covered to focus on a specific set of lanes. The agar plate phenotype is denoted for each sample at the top of the lane. The agar plate phenotypes are given as "SW" for a switcher phenotype, TSP for a temperature sensitive switcher splicer phenotype, and P for a permissive phenotype. In each of FIGS. 3A to 3L NIC indicates an N-extein, intein and C-extein containing intein modified protein; and NC indicates spliced protein containing the N- and C-exteins.
Figure 3B:
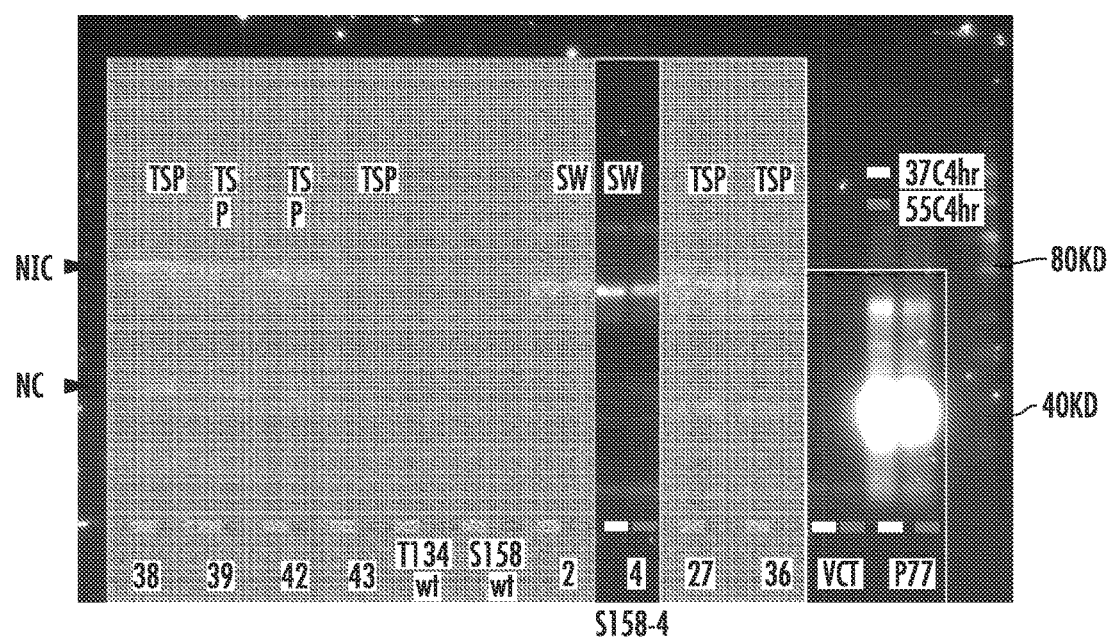
Figure 3C:
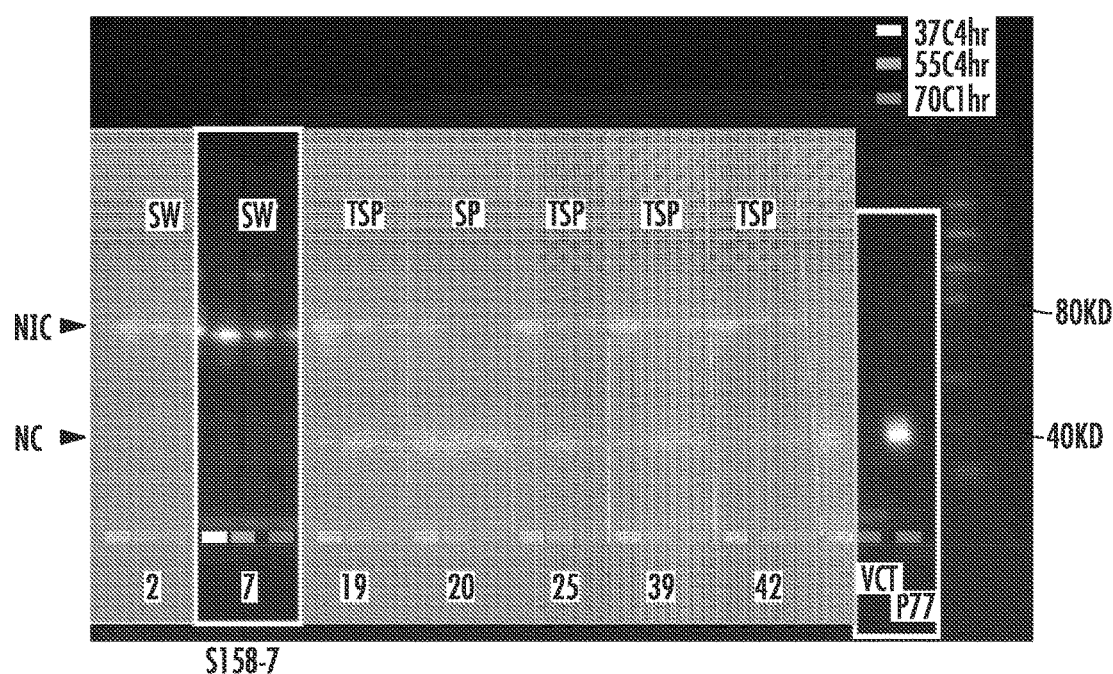
Figure 3D:
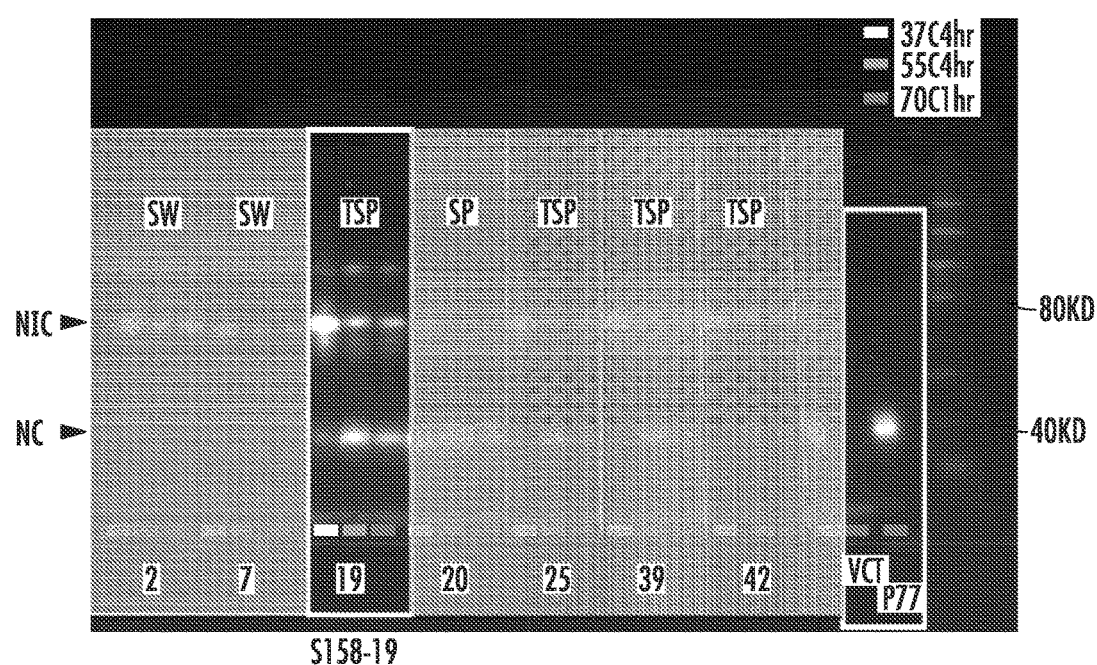
Figure 3E:
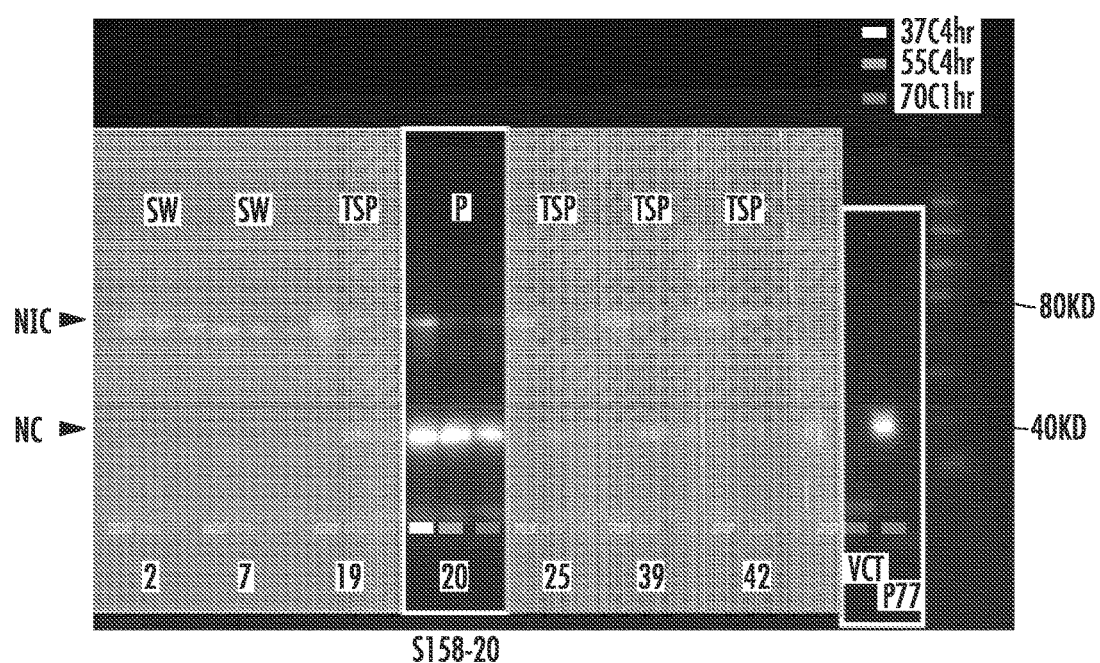
Figure 3F:
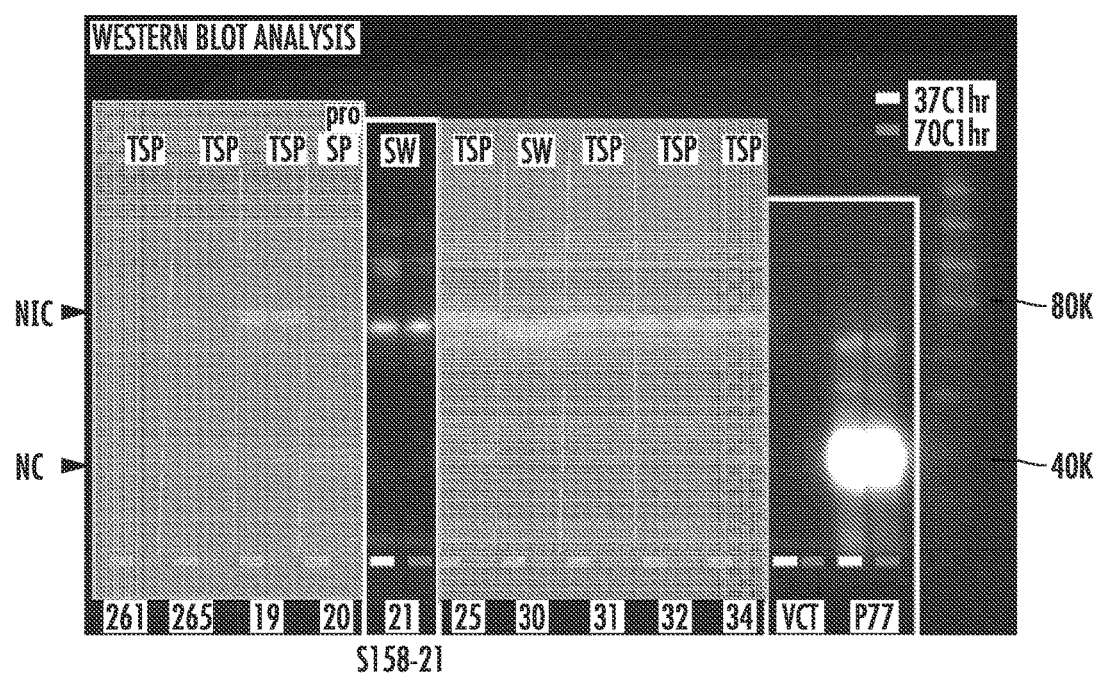
Figure 3G:
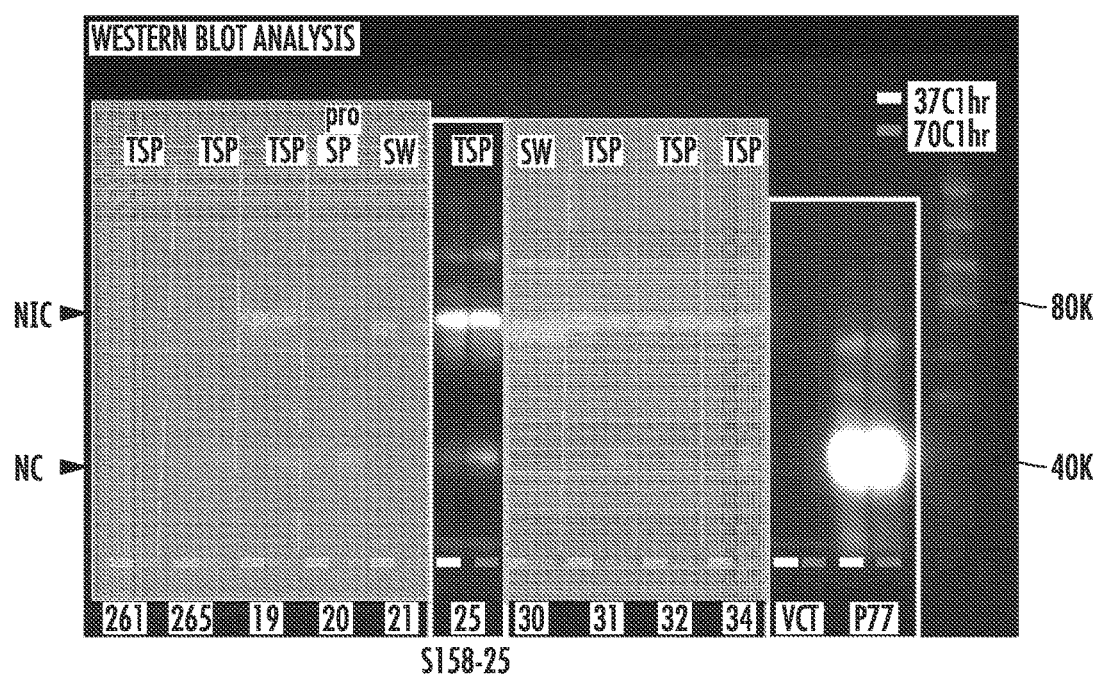
Figure 3H:
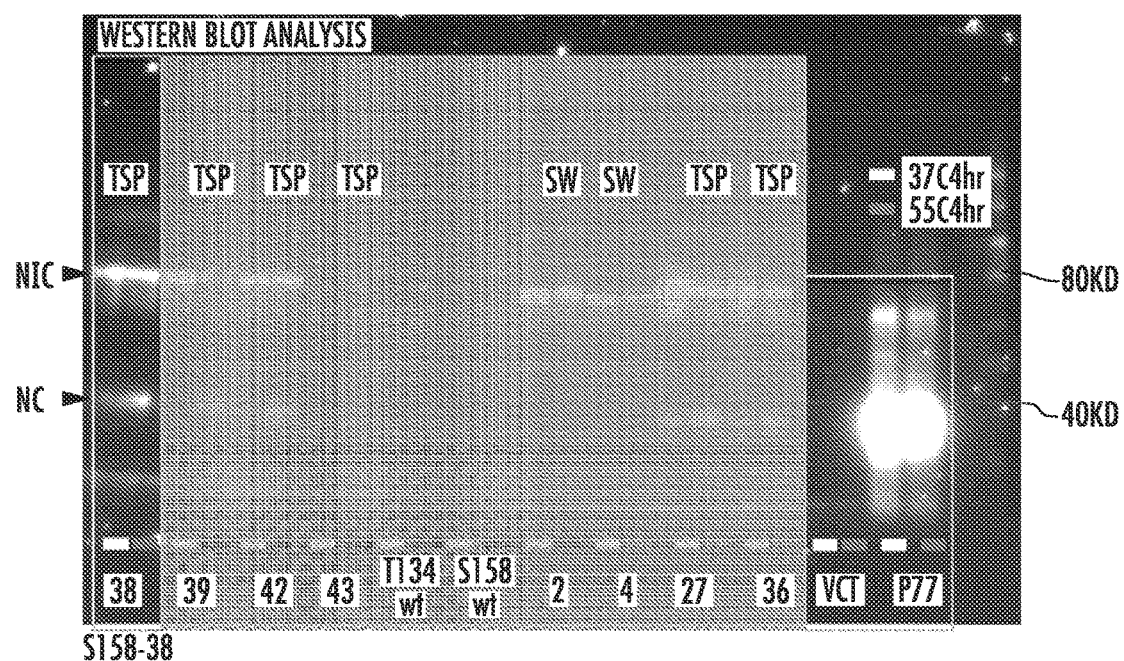
Figure 3I:
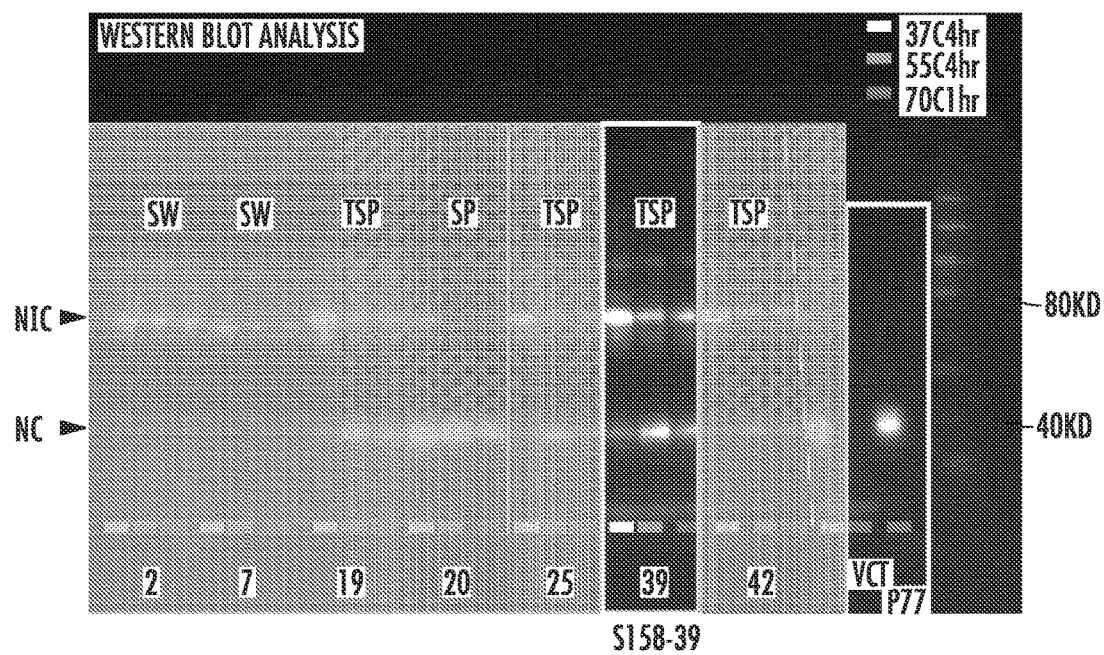
Figure 3J:
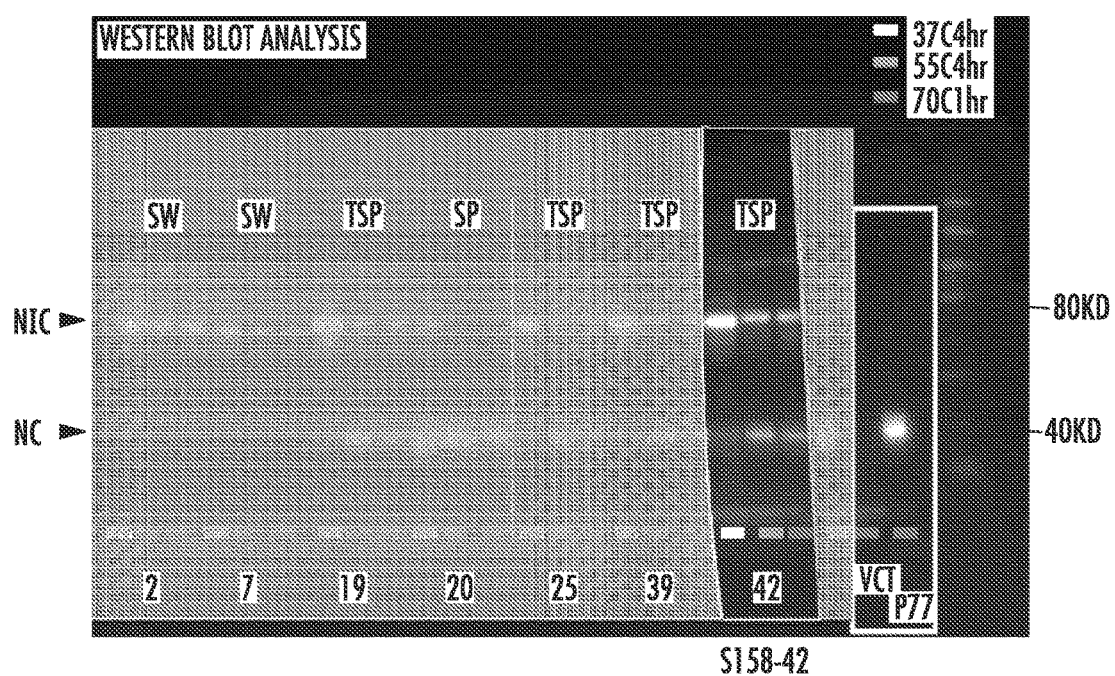
Figure 3K:
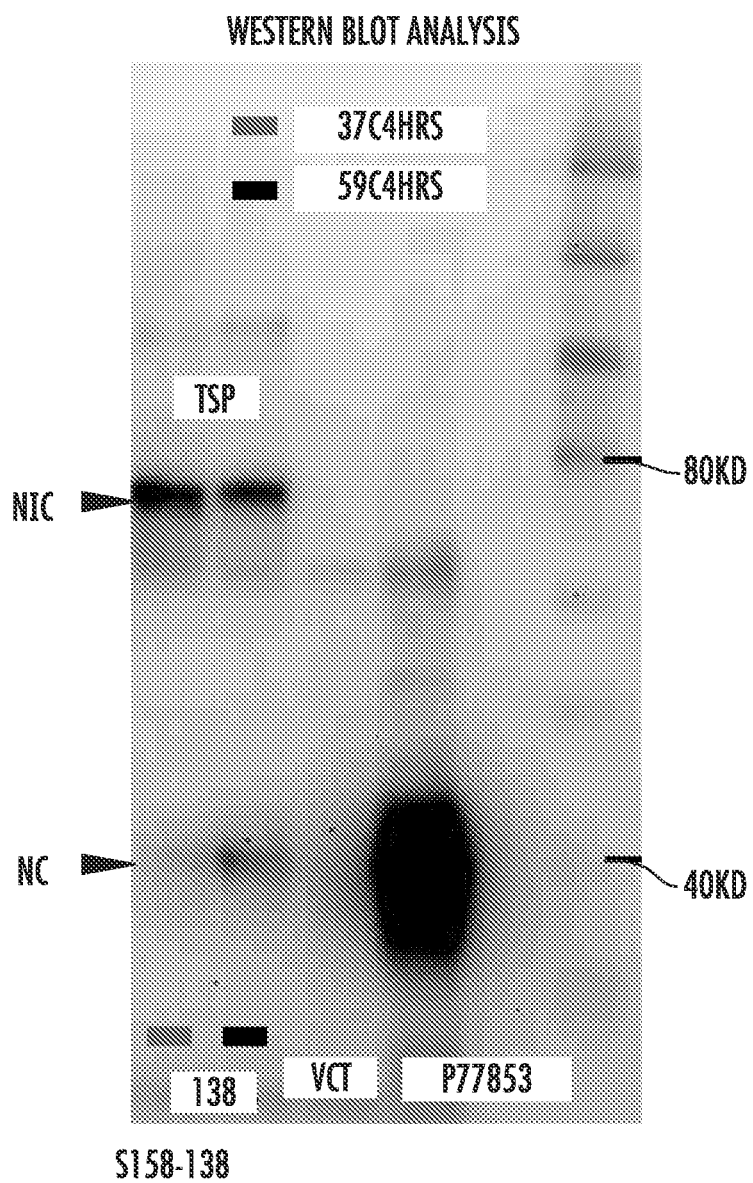

FIG. 3A illustrates a western blot showing the P77853-Tth-S158-2 protein (SEQ ID NO: 1672), which had a switcher phenotype in the agar plate assay. FIG. 3B illustrates a western blot showing the P77853-Tth-S158-4 protein (SEQ ID NO: 1673), which also had a switcher phenotype in the agar plate assay. FIG. 3C illustrates a western blot showing the P77853-Tth-S158-7 protein (SEQ ID NO: 1674), which also had a switcher phenotype in the agar plate assay. FIG. 3D illustrates a western blot showing the P77853-Tth-S158-19 protein (SEQ ID NO: 1675), which had a temperature sensitive switcher splicer phenotype. FIG. 3E illustrates a western blot showing the P77853-Tth-S158-20 protein (SEQ ID NO: 1676), which had a permissive phenotype in the agar plate assay. FIG. 3F illustrates a western blot showing the P77853-Tth-S158-21 protein (SEQ ID NO: 1677), which had a switcher phenotype in the agar plate assay. FIG. 3G illustrates a western blot showing the P77853-Tth-S158-25 protein (SEQ ID NO: 1678), which had a temperature sensitive switcher splicer phenotype. FIG. 3H illustrates a western blot showing the P77853-Tth-S158-38 protein (SEQ ID NO: 1679), which had a temperature sensitive switcher splicer phenotype. FIG. 3I illustrates a western blot showing the P77853-Tth-S158-39 protein (SEQ ID NO: 1680), which had a temperature sensitive switcher splicer phenotype. FIG. 3J illustrates a western blot showing the P77853-Tth-S158-42 protein (SEQ ID NO: 1681), which had a temperature sensitive switcher splicer phenotype. FIG. 3K illustrates a western blot showing the P77853-Tth-S158-138 protein (SEQ ID NO: 1691), which had a temperature sensitive switcher splicer phenotype.

Figure 3L:
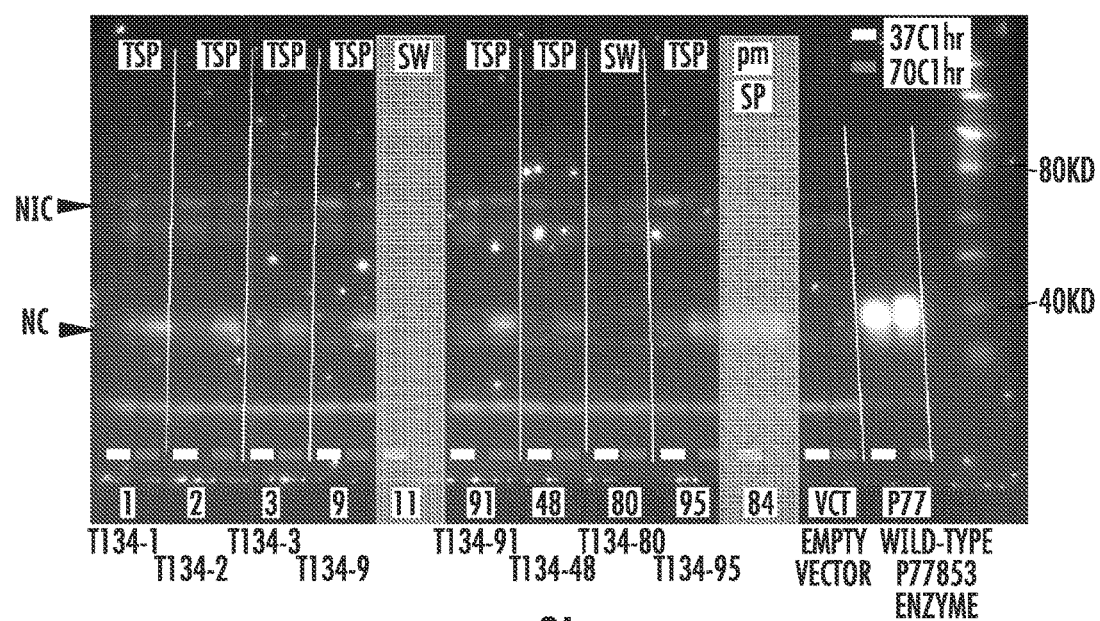

FIG. 3L illustrates a western blot showing the P77853-Tth-T134-1 protein (SEQ ID NO: 1629) (panel 1), P77853-Tth-T134-2 protein (SEQ ID NO: 1630) (panel 2), P77853-Tth-T134-3 protein (SEQ ID NO: 1631) (panel 3), P77853-Tth-T134-9 protein (SEQ ID NO: 1632) (panel 9), P77853-Tth-T134-91 protein (SEQ ID NO: 1644) (panel 91), P77853-Tth-T134-48 protein (SEQ ID NO: 38) (panel 48), P77853-Tth-T134-80 protein (SEQ ID NO: 1640) (panel 80), and P77853-Tth-T134-95 protein (SEQ ID NO: 1645) (panel 95) that were preheat treated at 37° C. (left lane in each of the before mentioned panels) and 70° C. (right lane in each of the before mentioned panels) for one hour. Also shown are lanes containing protein from the empty vector control (VCT) and wild-type P77853 protein (P77) that was preheat treated in the same manner. The phenotype of each protein is given above its corresponding lanes.

Based on both enzyme assay and western blot data in FIGS. 3A to 3L, incubation at temperatures between 55° C. and 70° C. for 4 hours increases intein splicing in many of the Tth intein modified P77853 xylanase candidates.

The T134 candidates with increased intein splicing on the western blot were tested in liquid assays using pretreatment at 37° C. or 59° C. pretreatment (PT) for four hours followed by a 12 hour reaction at 37° C. with substrate. Alternatively, each had no pretreatment (NPT) and a 5 hour reaction at either 37° C. or 70° C. was conducted. The results are tabulated in Table 3, below. Activity is quantified in an assay that measures the release of a dye from a labeled substrate and is expressed in arbitrary absorbance units, measured on a spectrophotometer or plate reader at a wavelength of 590 nm. The parenthetical percent in the 59° C. column indicates the fold activity change for 59° C. PT in comparison to 37° C. PT, which was calculated as Fold Change=([(activity after 59° C. PT)/(activity after 37° C. PT)]−1)×100. ND means not determined.

TABLE 3

| Intein Modified Protein | Sequence | Activity With 37° C. PT and 37° C. Reaction | Activity With 59° C. PT and 37° C. Reaction | Activity With NPT and 37° C. Reaction | Activity With NPT and 70° C. Reaction |
|---|---|---|---|---|---|
| T134 - 1 | SEQ ID NO: 1629 | 1.275 | 3.140 (146%) | 0.203 | 3.75 |
| T134 - 2 | SEQ ID NO: 1630 | 1.595 | 2.746 (72%) | 0.209 | 3.771 |

TABLE 3-continued

| Intein Modified Protein | Sequence | Activity With 37° C. PT and 37° C. Reaction | Activity With 59° C. PT and 37° C. Reaction | Activity With NPT and 37° C. Reaction | Activity With NPT and 70° C. Reaction |
|---|---|---|---|---|---|
| T134 - 3 | SEQ ID NO: 1631 | 0.280 | 0.983 (251%) | 0.368 | 1.711 |
| T134 - 9 | SEQ ID NO: 1632 | ND | ND | ND | ND |
| T134 - 12 | SEQ ID NO: 1633 | 1.515 | 2.090 (38%) | 0.349 | 3.748 |
| T134 - 36 | SEQ ID NO: 1634 | 0.653 | 1.597 (144%) | 0.193 | 5.734 |
| T134 - 42 | SEQ ID NO: 1635 | 0.537 | 1.264 (134%) | 0.165 | 6.830 |
| T134 - 43 | SEQ ID NO: 1636 | 0.633 | 1.992 (215%) | 0.229 | 5.689 |
| T134 - 45 | SEQ ID NO: 1637 | 0.181 | 0.725 (301%) | 0.073 | 6.068 |
| T134 - 48 | SEQ ID NO: 1638 | 0.662 | 1.084 (64%) | 0.1625 | 1.494 |
| T134 - 49 | SEQ ID NO: 1639 | 8.516 | 10.11 (19%) | 2.800 | 14.38 |
| T134 - 80 | SEQ ID NO: 1640 | 0.064 | 0.522 (715%) | 0.039 | 0.935 |
| T134 - 82 | SEQ ID NO: 1641 | 0.492 | 1.292 (163%) | 0.168 | 3.256 |
| T134 - 83 | SEQ ID NO: 1642 | 1.149 | 3.933 (242%) | 0.358 | 7.648 |
| T134 - 89 | SEQ ID NO: 1643 | 1.543 | 2.017 (31%) | 0.291 | 10.66 |
| T134 - 91 | SEQ ID NO: 1644 | 1.033 | 1.761 (70.1%) | 0.185 | 2.180 |
| T134 - 95 | SEQ ID NO: 1645 | 1.131 | 1.870 (65%) | 0.212 | 3.595 |
| T134 - 98 | SEQ ID NO: 1646 | 1.795 | 2.648 (47%) | 0.450 | 3.793 |
| T134 - 100 | SEQ ID NO: 1647 | 0.564 | 1.210 (115%) | 0.177 | 5.718 |
| T134 - 108 | SEQ ID NO: 1648 | 3.084 | 3.270 (6%) | 0.680 | 3.721 |
| T134 - 110 | SEQ ID NO: 1649 | 2.325 | 2.899 (25%) | 0.475 | 3.704 |
| T134 - 119 | SEQ ID NO: 1650 | 0.587 | 1.778 (203%) | 0.132 | 4.292 |
| T134 - 121 | SEQ ID NO: 1651 | 0.381 | 1.136 (199%) | 0.097 | 3.824 |
| T134 - 122 | SEQ ID NO: 1652 | 0.406 | 1.056 (160%) | 0.129 | 3.353 |
| T134 - 144 | SEQ ID NO: 1653 | 2.303 | 2.647 (15%) | 0.740 | 8.686 |
| T134 - 153 | SEQ ID NO: 1654 | 0.084 | 0.354 (321%) | 0.033 | 1.698 |
| T134 - 167 | SEQ ID NO: 1655 | 0.093 | 0.188 (103%) | 0.023 | 0.908 |
| T134 - 168 | SEQ ID NO: 1656 | 0.030 | 0.361 (1086%) | 0.035 | 0.257 |
| T134 - 173 | SEQ ID NO: 1657 | 0.911 | 1.572 (73%) | 0.198 | 1.883 |
| T134 - 174 | SEQ ID NO: 1658 | 0.240 | 1.278 (432%) | 0.050 | 1.720 |
| T134 - 175 | SEQ ID NO: 1659 | 0.448 | 1.220 (172) | 0.127 | 1.587 |
| T134 - 180 | SEQ ID NO: 1660 | 0.982 | 1.516 (54%) | 0.177 | 2.806 |
| T134 - 190 | SEQ ID NO: 1661 | 0.084 | 0.117 (39%) | 0.013 | 0.940 |
| T134 - 191 | SEQ ID NO: 1662 | ND | ND | ND | ND |
| T134 - 193 | SEQ ID NO: 1663 | 0.175 | 0.834 (376%) | 0.030 | 1.509 |
| T134 - 194 | SEQ ID NO: 1664 | 0.116 | 0.868 (649%) | 0.098 | 2.992 |
| T134 - 195 | SEQ ID NO: 1665 | 1.985 | 2.624 (32%) | 0.392 | 3.776 |
| T134 - 218 | SEQ ID NO: 1666 | 1.692 | 2.472 (46%) | 0.329 | 3.772 |
| T134 - 219 | SEQ ID NO: 1667 | 0.200 | 0.591 (195%) | 0.051 | 1.666 |
| T134 - 225 | SEQ ID NO: 1668 | 0.005 | 0.076 (1434%) | 0.008 | 0.020 |

TABLE 3-continued

| Intein Modified Protein | Sequence | Activity With 37° C. PT and 37° C. Reaction | Activity With 59° C. PT and 37° C. Reaction | Activity With NPT and 37° C. Reaction | Activity With NPT and 70° C. Reaction |
|---|---|---|---|---|---|
| T134 - 238 | SEQ ID NO: 1669 | 0.020 | 0.033 (64%) | 0.012 | 0.090 |
| T134 - 248 | SEQ ID NO: 1670 | 0.036 | 0.090 (149%) | 0.090 | 1.672 |
| T134 - 249 | SEQ ID NO: 1671 | ND | ND | ND | ND |

Additional T134 insertion site intein modified P77853 xylanases developed include those in SEQ ID NOS: 1711-1712.

Using the Pretreatment assay (PT) described above, the switching profile was analyzed for temperature induced xylanase reactivation of over 300 Tth intein modified P77853 xylanase candidates in E. coli SOLR™ cells (Stratagene). Xylanase activity data was collected for all samples with duplicates and with or without preheat treatment. For preheat treatment, one set of samples was incubated at 37° C. and another at 59° C., both for 4 hours. After cooling the samples on ice, AZCL-xylan substrate was added and the mixture was left at 37° C. for up to 12 hrs. AZCL-xylan substrate was added directly to another two sets of samples without being preheated, and set to react at 37° C. for 5 hrs. The results for the Tth S158 P77853 xylanase are presented in the Table 4, below. While 59° C. preheated samples always had improved activity in general, nearly a third of all Tth intein modified P77853 xylanase candidates demonstrated at least a 2-fold difference (increase) in activity between 37° C. and 59° C. preheat treatment. That is, the activity measured at 37° C. was often twice as high for samples that were preheat treated at 59° C. than for samples that were preheat treated at 37° C. These candidates were further analyzed on western blot. Activity is expressed in arbitrary absorbance units as measured on a plate reader at a wavelength of 590 nm. The parenthetical percent in the 59° C. column indicates the activity change for 59° C. PT in comparison to 37° C. PT, which was calculated as the Percent Fold Change=([(activity after 59° C. PT)/(activity after 37° C. PT)]−1)×100%. ND means not determined.

TABLE 4

| Intein Modified Protein | Sequence | Activity With 37° C. PT and 37° C. Reaction | Activity With 59° C. PT and 37° C. Reaction | Activity With NPT and 37° C. Reaction | Activity With NPT and 70° C. Reaction |
|---|---|---|---|---|---|
| S158 - 2 | SEQ ID NO: 1672 | 1.046 | 2.475 (136%) | 0.189 | 3.751 |
| S158 - 4 | SEQ ID NO: 1673 | 1.108 | 2.795 (152%) | 0.212 | 3.714 |
| S158 - 7 | SEQ ID NO: 1674 | 0.447 | 0.9445 (111%) | 0.131 | 2.296 |
| S158 - 19 | SEQ ID NO: 1675 | 0.820 | 1.502 (83%) | 0.165 | 3.354 |
| S158 - 20 | SEQ ID NO: 1676 | 2.772 | 2.930 (6%) | 0.708 | 3.784 |
| S158 - 21 | SEQ ID NO: 1677 | 0.869 | 2.653 (205%) | 0.195 | 3.460 |
| S158 - 25 | SEQ ID NO: 1678 | 0.568 | 0.926 (63%) | 0.152 | 3.156 |
| S158 - 30 | SEQ ID NO: 1699 | 1.139 | 2.884 (153%) | 0.205 | 3.394 |
| S158 - 38 | SEQ ID NO: 1679 | 0.540 | 0.830 (54%) | 0.139 | 3.069 |
| S158 - 39 | SEQ ID NO: 1680 | 0.399 | 0.565 (42%) | 0.136 | 2.302 |
| S158 - 42 | SEQ ID NO: 1681 | 0.337 | 0.505 (50%) | 0.130 | 1.999 |
| S158 - 107 | SEQ ID NO: 1682 | 0.515 | 1.981 (285%) | 0.911 | 1.572 |
| S158 - 111 | SEQ ID NO: 1683 | 0.392 | 1.160 (196%) | 0.073 | 1.306 |
| S158 - 112 | SEQ ID NO: 1684 | 0.451 | 1.239 (175%) | 0.075 | 0.947 |
| S158 - 113 | SEQ ID NO: 1685 | 0.523 | 1.886 (257%) | 0.077 | 1.622 |
| S158 - 115 | SEQ ID NO: 1686 | 0.850 | 2.790 (288%) | 0.085 | 1.832 |
| S158 - 128 | SEQ ID NO: 1687 | 0.609 | 1.941 (219%) | 0.083 | 1.515 |
| S158 - 131 | SEQ ID NO: 1688 | 0.451 | 1.239 (175%) | 0.075 | 0.947 |
| S158 - 132 | SEQ ID NO: 1689 | 0.320 | 0.625 (95%) | 0.071 | 0.682 |
| S158 - 137 | SEQ ID NO: 1690 | 0.417 | 1.197 (187%) | 0.068 | 1.339 |

TABLE 4-continued

| Intein Modified Protein | Sequence | Activity With 37° C. PT and 37° C. Reaction | Activity With 59° C. PT and 37° C. Reaction | Activity With NPT and 37° C. Reaction | Activity With NPT and 70° C. Reaction |
|---|---|---|---|---|---|
| S158 - 138 | SEQ ID NO: 1691 | 0.422 | 1.080 (156%) | 0.072 | 0.992 |

Additional S158 insertion site intein modified P77853 xylanases developed include those in SEQ ID NOS: 1700-1710.

Figure 4A:
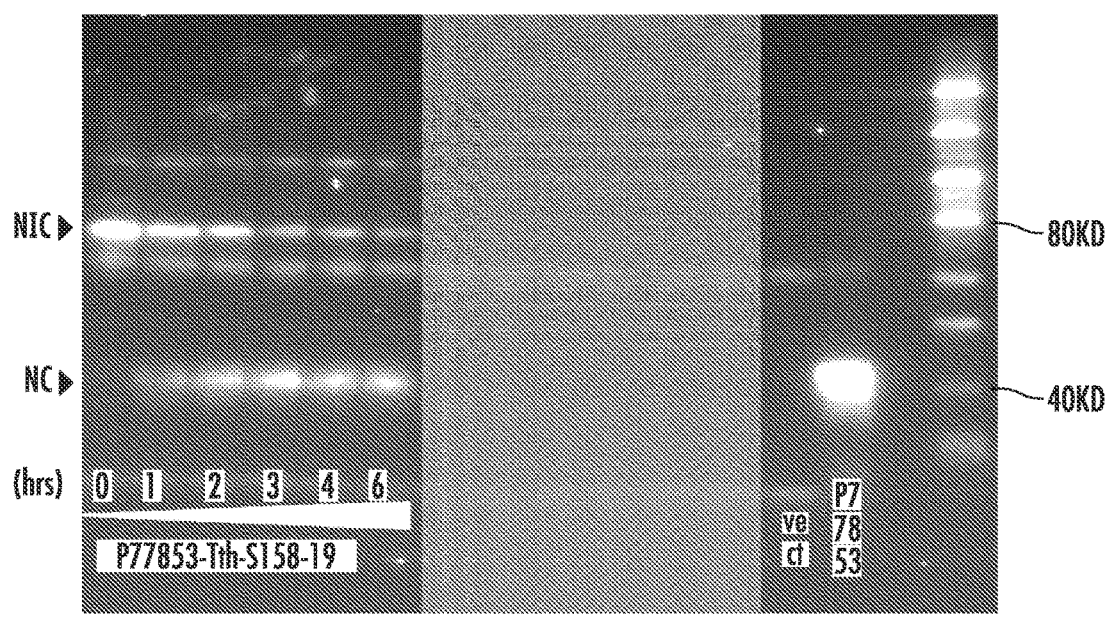
FIGS. 4A to 4C illustrate western blot analysis for S158 Tth intein-modified P77853 xylanase mutants.
Figure 4B:
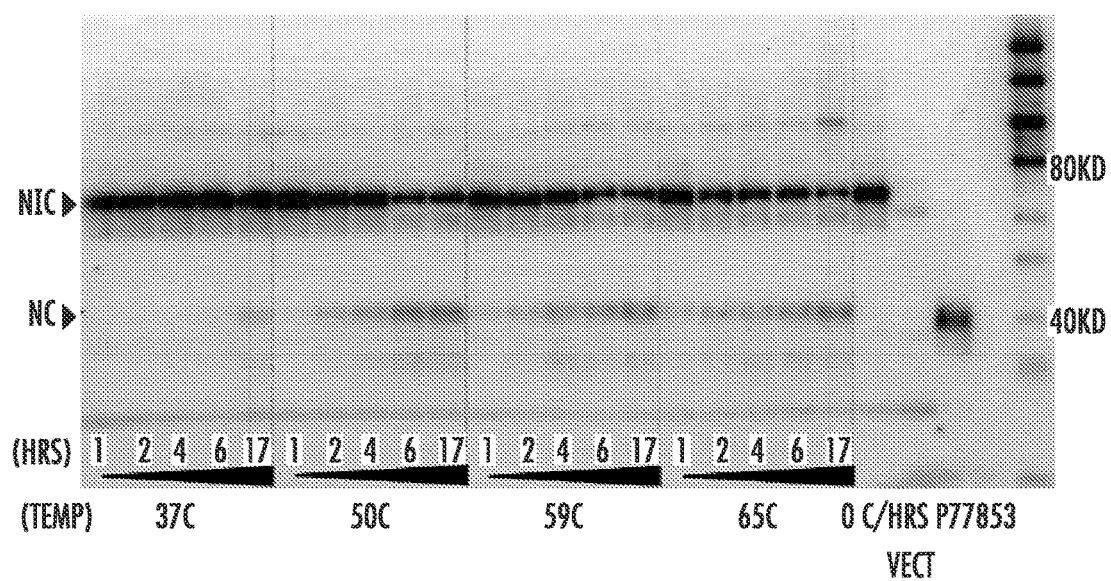
Figure 4C:
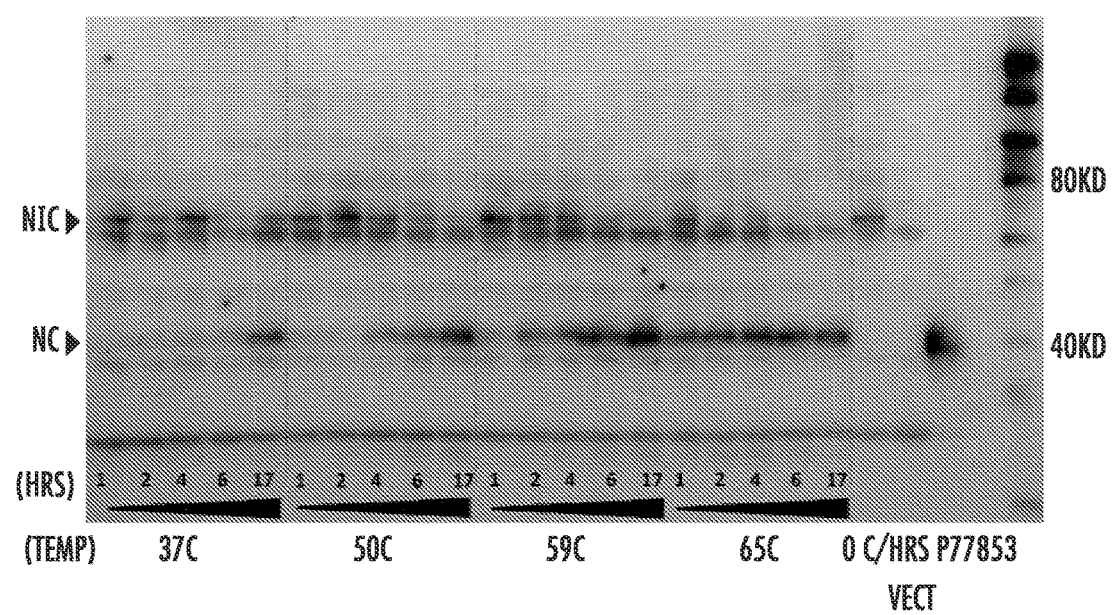

A time course splicing assay was performed and splicing was checked on western blots for each of the intein-modified P77853 candidate samples with either the T134 insertion or S158 insertion in the tables above. FIG. 4A illustrates the time course splicing assay for the S158-19 sample. Protein extracts were incubated at 59° C. for six hours, with samples taken at the 0, 1, 2, 3, 4, and 6 hours, as labeled in FIG. 4A. The right hand side of FIG. 4A shows the empty expression vector control and the wild-type P77853 positive control, as well as molecular weight standards. For Tth intein modified P77853 xylanase candidate S158-19, which accumulated precursor protein to high level, a decreased intein modified enzyme precursor level is correlated directly with accumulation of spliced mature protein. This accumulation of spliced mature xylanase peaked at 4 Hrs. when samples were heat-treated at 59° C. However, splicing at 59° C. was observed over six hours. And splicing was observed at temperatures from 50° C. to 59° C. As time of incubation increased, the amount of NIC Tth intein-modified S158-19 P77853 decreases while the amount of P77853 increases, indicative of increased intein splicing as time progresses during the 59° C. incubation. Similarly, FIG. 4B illustrates a western blot analysis for S158-30-103 Tth intein-modified P77853 xylanase (SEQ ID NO: 1701). Protein samples were incubated at either 37° C., 50° C., 59° C., or 65° C. for different amounts of time (1, 2, 3, 4, and 6 hours) as indicated in FIG. 4B. The empty vector and wild-type P77853 control samples are shown on the far right along with a molecular weight ladder. FIG. 4B shows that as time and temperature increases, there is an increase in mature P77853 enzyme (NC) formation, while there is a decrease in Tth intein-modified S158-30-103 P77853 xylanase (NIC). Likewise, FIG. 4C illustrates a western blot analysis for T134-100-101 Tth intein-modified P77853 xylanase (SEQ ID NO: 1711). Protein samples were incubated at either 37° C., 50° C., 59° C., or 65° C. for different amounts of time (1, 2, 4, 6, and 17 hours). The empty vector and wild-type P77853 control samples are shown on the far right along with a molecular weight ladder. FIG. 4C shows that as time and temperature increases, there is an increase in wild-type P77853 formation (NC), while there is a decrease in the amount of Tth intein-modified S158-30-103 P77853 xylanase (NIC), indicative of increase intein splicing. This figure shows that as time and temperature increases, there is an increase in P77853 formation, while there is a decrease in the amount of Tth intein-modified S158-30-103, indicative of increase intein splicing.

Unlike the activity-based Pretreatment assay above, which provides quantitative measurement of enzyme reactivation upon preheat treatment, a western blot based splicing assay offers the advantage of a visual demonstration of splicing. About 90 intein modified enzyme candidates that performed well in the Pretreatment assay were analyzed on western blot. For each individual candidate analyzed, a splicing profile was established. A splicing profile consists of precursor level, precursor stability, spliced mature protein level, and cleavage product level, each at two temperatures (usually selected from room temperature, 25° C., 37° C., 50° C., 55° C., 59° C., 65° C., or other temperatures as desired). For some intein modified proteins, samples were taken over time during a heat pretreatment and western blotted to investigate the kinetics of splicing.

Mutations to amino acids capable of enhancing intein switching and splicing (DNA sequence data) were identified for some intein modified enzymes, as described below. These mutations were specific to the specific intein modified enzyme as defined by a single target protein, a single intein, and a single insertion site.

From the Tth intein modified P77853 xylanase candidates, switching candidates and TSP candidates were submitted for DNA sequencing, along with Tth intein modified P77853 xylanase candidates that demonstrated splicing in the western blot analysis. Amino acids both in the Tth intein and P77853 residues at the intein-extein junction were identified that are associated with enhanced switching and splicing. For candidates generated from the insertion of the Tth intein in P77853 at the T134 site of P77853, a Tth intein mutation from P71 (amino acid 71 of the Tth intein) to L, T, or Q (SEQ ID NOS: 1928, 1929, and 1930) is associated with a TSP phenotype. A P136 single insertion (+3 portion of the C-extein) was also associated with a TSP phenotype (SEQ ID NO: 1931). No combination of these mutations (P71 to L/T/Q, or insertion at P136) occurred in any of the TSP candidates that were sequenced. In the case of P136 insertion, there were additional mutations, most noticeably an S to V substitution at S135 site (+2 position of the C-extein (SEQ ID NO: 1932)). These double mutants were also classified as belonging to the TSP family. The remaining candidates from the 61 displayed a switching phenotype but temperature-sensitive splicing was difficult to detect.

Tth intein-modified P77853 xylanases, constructed by intein insertion at S158, were analyzed and different TSP constructs were identified. Seventeen R51G(S) (amino acid 51 of the Tth intein) substitutions in the Tth intein (SEQ ID NO: 91) were identified (SEQ ID NOS: 1675, 1678-1681, 1689, 1691, 1700-1708, and 1710) and all were associated with TSP. Sequencing data suggests that these intein mutations that correlate with the TSP phenotype play a role in the temperature exposure-dependent splicing of the Tth intein-modified P77853 xylanases when inserted at these specific locations. Additional evidence to support TSP element's role in splicing comes from structural analysis of the mutations on the surface of the intein. Both R51 and P71 of the Tth are predicted to be in close proximity to the intein-extein junction and therefore the active site for intein cleavage and splicing.

Summary of Results from Examples 1-5

One xylanase, P77853, was modified with an intein and analyzed as set forth above. Multiple P77853 mutagenized intein libraries were created by inserting a mutagenized intein into the enzyme. Multiple mutagenized inteins and multiple intein insertion sites were used to create the library. Each modified enzyme in the library had a single mutagenized intein inserted into a single insertion site. From about 10 million mutants in the library, 500 candidates were isolated. The candidates were analyzed by DNA sequencing, enzyme activity assay, temperature-sensitive changes in activity and splicing. It was established that preheat treatment at a temperature near 60° C. most often induces switching; i.e., activity changes, of the intein-modified enzyme. In some candidates, switching is correlated with intein splicing. It was also found that particular amino acid changes in inteins and exteins, particularly near the intein-extein junction are significant in enhancing intein splicing or temperature sensitivity. These amino acid changes are dependent upon the specific intein, target enzyme, and intein insertion site.

Inserting the Tth intein into P77853, which does not contain an intein in its native sequence resulted in TSP switching phenotypes as described in the examples above. The P77853 T134 site is located at the junction of a beta-sheet and a loop region and the SVM score ranks this in the top 5 highest probability splice sites. Additionally, increased splicing occurs with a mutation near the insertion site to introduce a +2 proline, which correlates to a higher SVM score. Inserting the Tth intein in the P77853 S158 site, which is the 7$^{th}$ closest site to the active site residues (only 6.6 angstroms away) and also occurs at the junction of a beta-sheet loop region, resulted in intein-modified candidates that were capable of temperature dependent splicing and both switching and TSP phenotypes.

Examples of intein modified xylanses are provided in SEQ ID NOS: 1629-1712.

Example 6

Examples of Intein modified cellulases are provided in SEQ ID NOS: 1713-1784.

Example 7—Cellulase Assays and Purification

The cellulase Ace1 (endoglucanase E1 from *Acidothermus cellulolyticus* 11B) is an endoglucanase (EC 3.2.1.4) from *Acidothermus cellulolyticus* (Genbank accession P54583). The enzyme has an N-terminal catalytic domain (CD) with homology to members of the glycosyl hydrolase 5 family of enzymes and a C-terminal cellulose binding domain with homology to the carbohydrate binding module 2 (CBM2) family of proteins. The CD and CBM2 domains in P54583 are joined by a serine-, threonine-, and proline-rich linker domain. P54583 has been expressed from heterologous systems, including plants, and has been shown to effectively hydrolyze plant-derived cellulosic material.

Expression and characterization of P54583.

Figure 5:
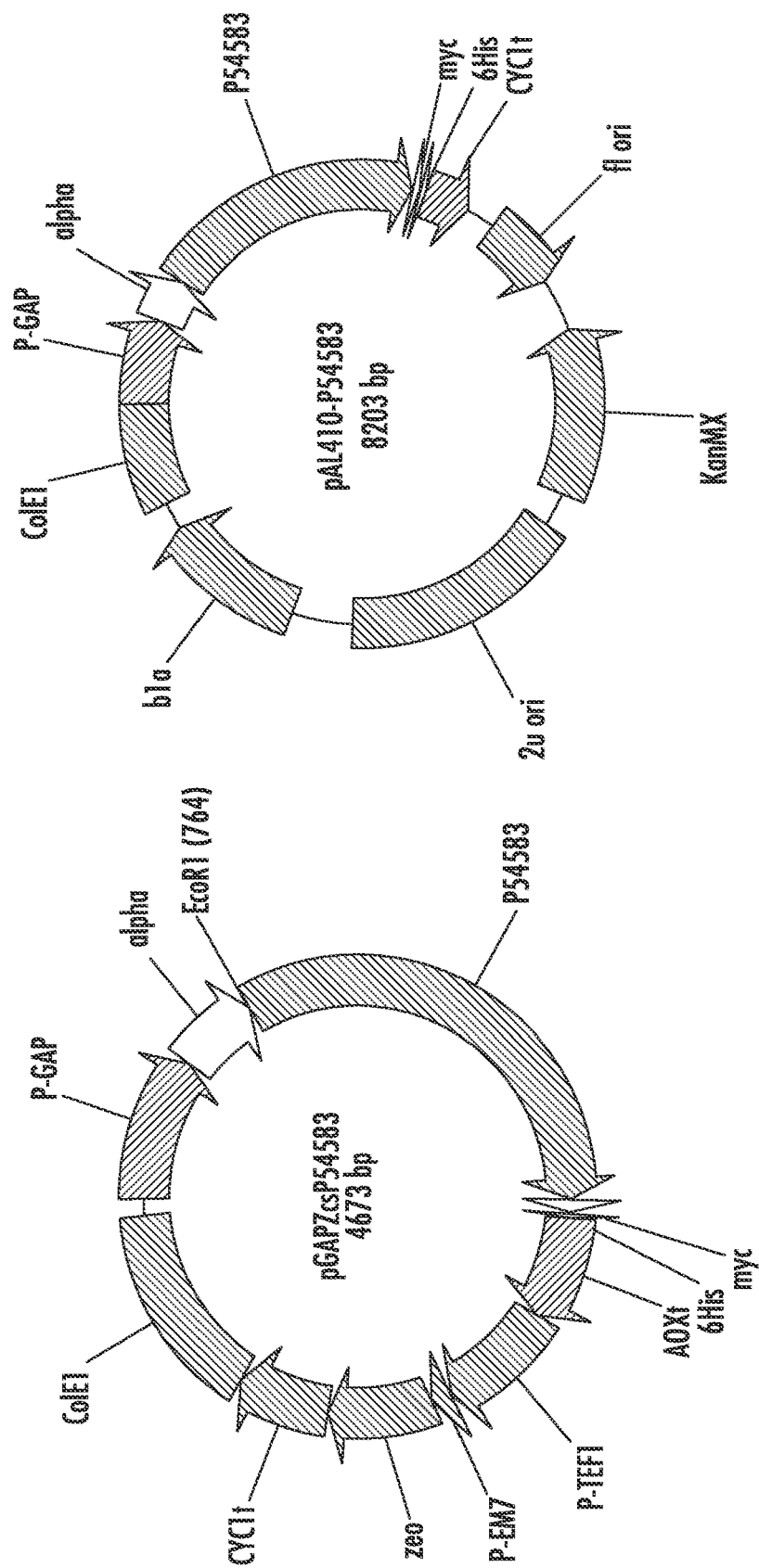
FIG. 5 illustrates plasmid vectors for expressing and secreting intein modified proteins; e.g., endoglucanases derived *Acidothermus cellulolyticus*, in yeast cells.

Referring to FIG. 5, plasmids pGAPZα and pAL410 are illustrated with cellulase inserts. The plasmids are not drawn to scale. In FIG. 5, the annotations have the following meaning: P-GAP, nominally constitutive yeast GAP promoter; alpha, secretion signal from yeast alpha mating factor, which is translated as an N-terminal fusion to the endoglucanase; P54583, coding sequence for Ace1 endoglucanase (see below); AOXt, transcriptional terminator and polyadenylation signal derived from the yeast AOX gene; P-TEF1, promoter from the yeast TEF1 gene; P-EM7, promoter derived from the yeast AM7 gene; zeo, coding sequence conferring zeocin resistance in yeast and *E. coli*; CYC1t, transcriptional terminator and polyadenylation signal derived from the yeast CYC1 gene; ColEI, region that enables replication of the plasmid in *E. coli*; f1 ori, sequence for generating single-stranded plasmid derivatives; KanMX, gene conferring resistance to G418 in yeast; 2u ori, 2 micron origin, enabling plasmid replication in yeast cells; bla, gene conferring ampicillin resistance in bacterial cells. Note that P54583 is expressed with C-terminal 6His and myc translational fusions from pGAPZα-P54583 and pAL410-P54583.

A codon-optimized version of P54583 was prepared. The DNA sequence of P54583 as optimized for expression in plants is shown below. Note: this sequence corresponds only to amino acid residues 42 through 562 of the native polypeptide in *A. cellulolyticus*, which corresponds to the "mature" form of the endoglucanase and lacks the signal peptide (amino acid residues 1 through 41). The GCT codon following the ATG start codon encodes amino acid 42.

Codon-Optimized Version of P54583

(SEQ ID NO: 1933)
ATGGCTGGAGGAGGATACTGGCACACTTCCGGCAGGGAGATCCTCGACGC

AAATAACGTTCCAGTCAGAATCGCCGGGATTAATTGGTTTGGCTTCGAAA

CGTGTAACTACGTGGTTCACGGCCTGTGGTCTCGGGATTACAGATCAATG

CTCGACCAGATCAAATCCTTGGGGTATAATACAATTAGGCTGCCCTACAG

CGATGACATTCTTAAGCCTGGAACCATGCCGAACTCGATTAATTTCTACC

AAATGAACCAGGATCTGCAGGGATTGACTTCTCTGCAGGTTATGGACAAG

ATCGTGGCGTACGCCGGCCAAATCGGGCTCAGAATTATTTTGGATCGGCA

CAGGCCAGACTGCTCAGGTCAGTCGGCCCTGTGGTACACAAGCTCCGTGT

CAGAGGCAACATGGATTTCAGATCTTCAAGCCCTCGCACAACGCTATAAA

GGCAACCCCACGGTTGTGGGATTCGACCTTCACAACGAACCTCACGATCC

GGCCTGTTGGGGCTGCGGGGACCCTTCGATCGACTGGAGACTGGCAGCGG

AGAGGGCTGGTAACGCCGTTCTCAGCGTCAATCCCAACTTGCTGATCTTT

GTGGAGGGAGTTCAGTCCTACAACGGCGATTCTTACTGGTGGGGCGGAAA

TCTCCAAGGCGCAGGGCAGTATCCTGTCGTGCTTAACGTTCCGAATCGCC

TGGTCTACTCAGCACACGACTACGCGACTAGCGTGTACCCACAGACGTGG

TTCTCCGATCCCACATTTCCTAACAATATGCCGGGAATCTGGAACAAGAA

TTGGGGTTACTTGTTTAACCAAAACATTGCTCCAGTTTGGTTGGGTGAAT

TTGGCACCACTCTTCAGTCGACGACAGACCAAACCTGGCTGAAAACCCTC

GTCCAGTATTTGCGGCCAACTGCTCAGTACGGAGCAGATTCTTTTCAATG

GACGTTCTGGTCTTGGAATCCTGACTCCGGGGATACAGGCGGTATCCTGA

AAGACGATTGGCAGACCGTGGACACTGTTAAGGACGGGTACTTGGCGCCG

ATTAAAAGCTCGATCTTTGACCCAGTCGGCGCTAGCGCTTCCCCATCTTC

ACAACCTTCGCCGAGCGTCAGCCCCAGCCCAAGCCCAAGCCCGTCTGCCA

GCAGAACCCCACTCCCACACCTACCCCCACGGCCTCACCAACTCCGACG

CTCACTCCTACGGCGACGCCAACACCAACTGCTTCACCCACTCCTAGCCC

CACCGCAGCGAGCGGGGCTAGGTGCACCGCTTCTTACCAGGTCAACTCTG

ACTGGGGTAATGGCTTCACCGTGACTGTGGCGGTCACTAACTCAGGAAGC

GTCGCGACGAAAACCTGGACTGTGTCCTGGACGTTCGGGGGCAACCAAAC

AATCACCAACAGCTGGAACGCTGCAGTTACGCAGAATGGGAAAGCGTCA

CGGCGCGCAATATGAGCTACAACAACGTGATTCAACCAGGCCAGAATACC

```
-continued
ACATTCGGTTTTCAAGCAAGCTATACCGGGTCAAACGCTGCCCCAACTGT

CGCTTGTGCTGCCTCA.
```

A DNA fragment carrying this sequence was ligated into the *Pichia pastoris* integrative expression vector pGAPZα (Invitrogen, Carlsbad Calif.), described above. pGAPZα is an integrative vector for transformation of *P. pastoris* GS115. The resulting plasmid, pGAPZα-P54583 (FIG. 5), was then introduced into *P. pastoris* GS115 cells according to the Invitrogen protocol. Recombinants were selected on the basis of zeocin resistance, and scored for their ability to mobilize the dye from AZCL-HE-cellulose (Megazyme International Ireland Ltd) on agar plates.

Figure 6:
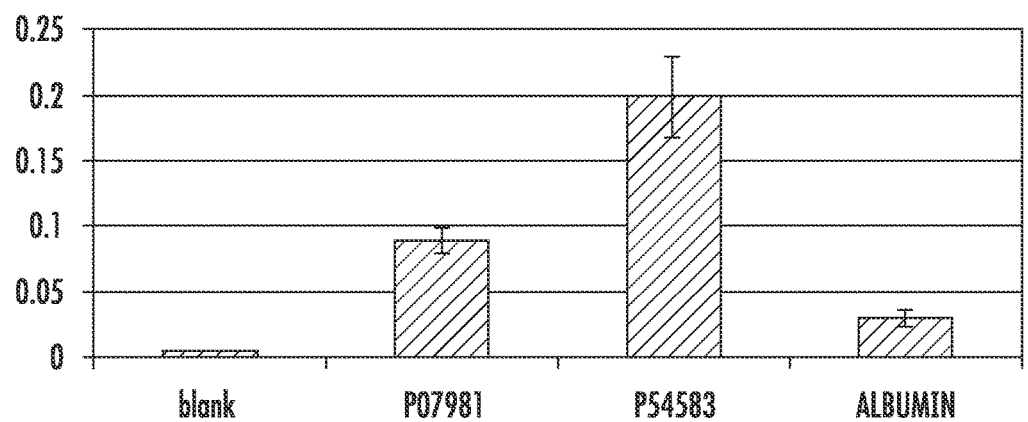
FIG. 6 illustrates activity assays of *Pichia* strains expressing either P07981 (endoglucanase EG-1 from *Trichoderma reesei*), P54583, or albumin (as a negative control).

*Pichia* strains expressing either P54583, an unrelated endoglucanase from *Trichoderma reesei* (P07981 from glycosyl hydrolase family 7), or albumin were grown in rich media in the presence of zeocin. Supernatants were collected from these cultures and assayed for endoglucanase activity using the Cellazyme C assay (see below), in which endoglucanases release blue dye (AZCL) from a cellulosic substrate (Megazyme International Ireland, Ltd.). These assays demonstrated that the *Pichia* clones expressing P54583 produced approximately twice as much endoglucanase activity as did the clones expressing P07981. See FIG. 6. In FIG. 6, Blank is a sample containing uninoculated culture medium, and activity is expressed in cellulase units.

Figure 7:
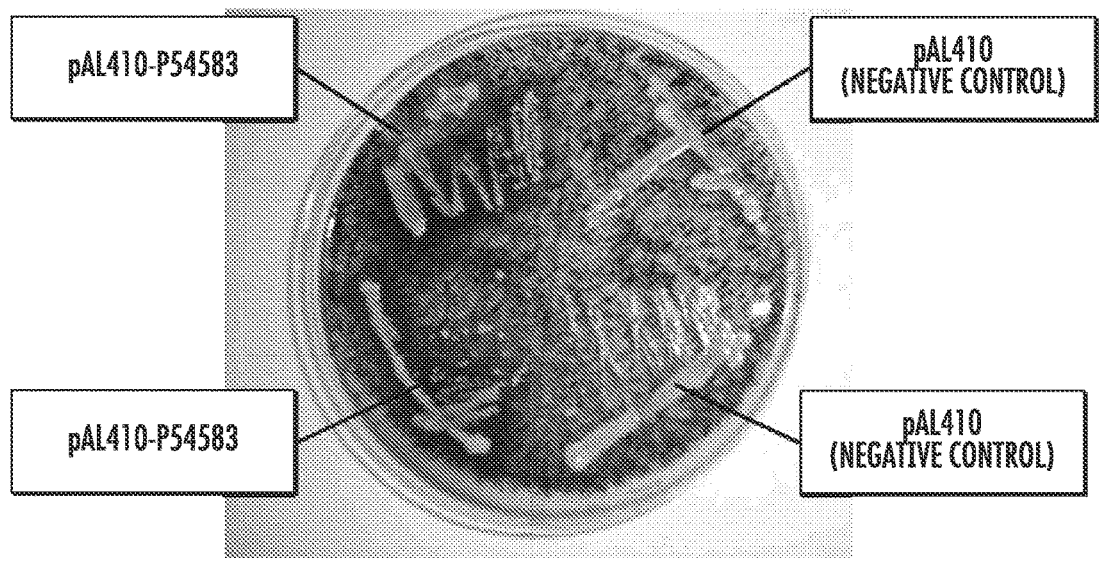
FIG. 7 illustrates a plate assay for secretion of P54583 from *S. cerevisiae*.

As mutagenesis might be more easily accomplished in *S. cerevisiae*, the coding sequence for P54583 was transferred from pGAPZα-P54583 to pAL410, producing the plasmid pAL410-P54583 (FIG. 5). pAL410 is an autonomously replicating vector for transformation of *S. cerevisiae*. *S. cerevisiae* strains carrying pAL410-P54583 plasmid or the negative control plasmid pAL410 were scored onto YPD agar plates containing 100 mg/L G418 and onto which an overlay of 0.2% AZCL-HE-cellulose (Megazyme) in 2% agar had been applied. Details of the plate activity assay are provided below. As shown in FIG. 7, two independent transformants carrying pAL410-P54583 and two carrying pAL410 were scored onto AZCL-HE-cellulose. Mobilization of the AZCL dye was clearly visible only in the vicinity of the clones that secreted active endoglucanase.

Measuring Activity of Endoglucanases and Intein-Modified Derivatives:

Plate Activity Assays.

Activity assay plates were prepared by applying a thin layer of liquid agar containing 0.2% AZCL-HE cellulose substrate over YPD G418 100 mg/L selection plates. Once the plates were solidified, yeast cells containing genes of interest were plated on top of the substrate overlay. Cells were then grown at 30° C. Active endocellulase will mobilize AZCL dye and a blue halo will form in the surrounding media. This is a qualitative assay to evaluate activity from different host strains and constructs over varying temperatures and time frames. This can also be tested to see activity in intein modified P54583 derivatives.

Liquid Phase Activity Assays.

The liquid assays allow for greater variation in assay and sample preparation conditions and give quantifiable results by absorbance readings on a spectrophotometer or plate reader. Assay conditions may vary for a wide range of pH, temperature, duration, and sample preparation. Sample preparation for this assay can include varied growth conditions, concentration or purification methods and pretreatments. This assay can be modified for measuring activity within the culture supernatants or cell pellets.

Cellazyme C tablet (Megazyme) Substrate Liquid Assay.

Figure 8:
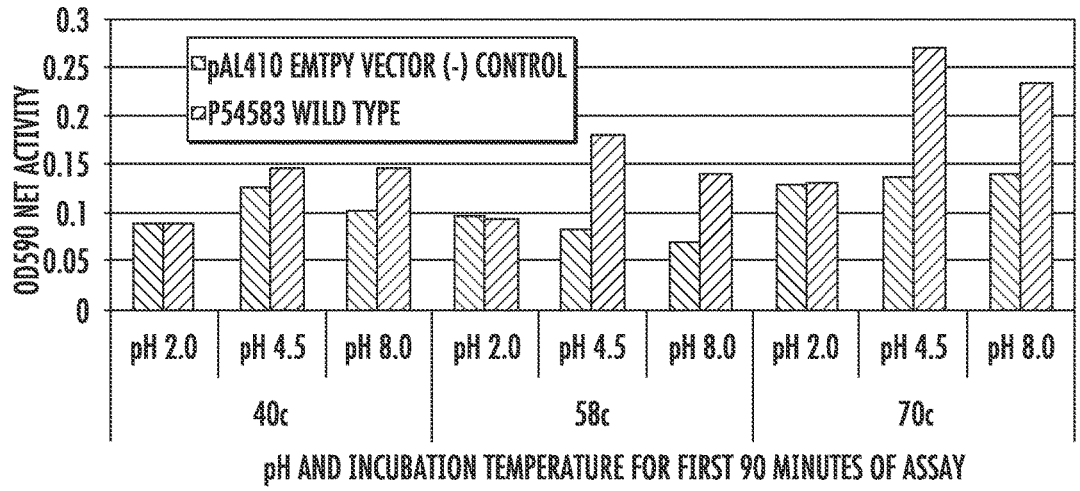
FIG. 8 illustrates P54583 activity over different pH levels and at different temperatures.
Figure 9:
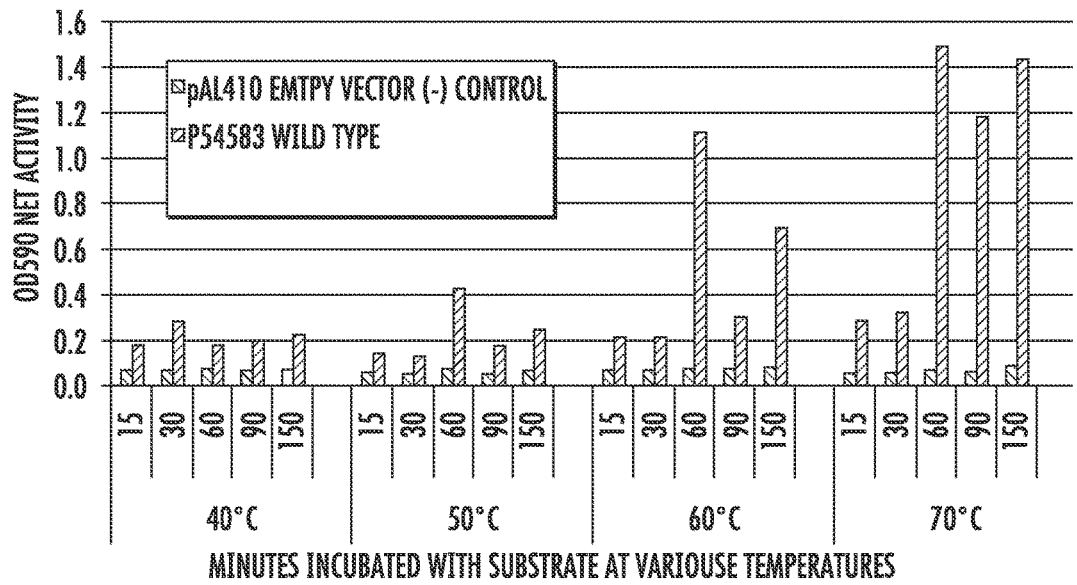
FIG. 9 illustrates P54583 activity over time and at different temperatures.
Figure 10:
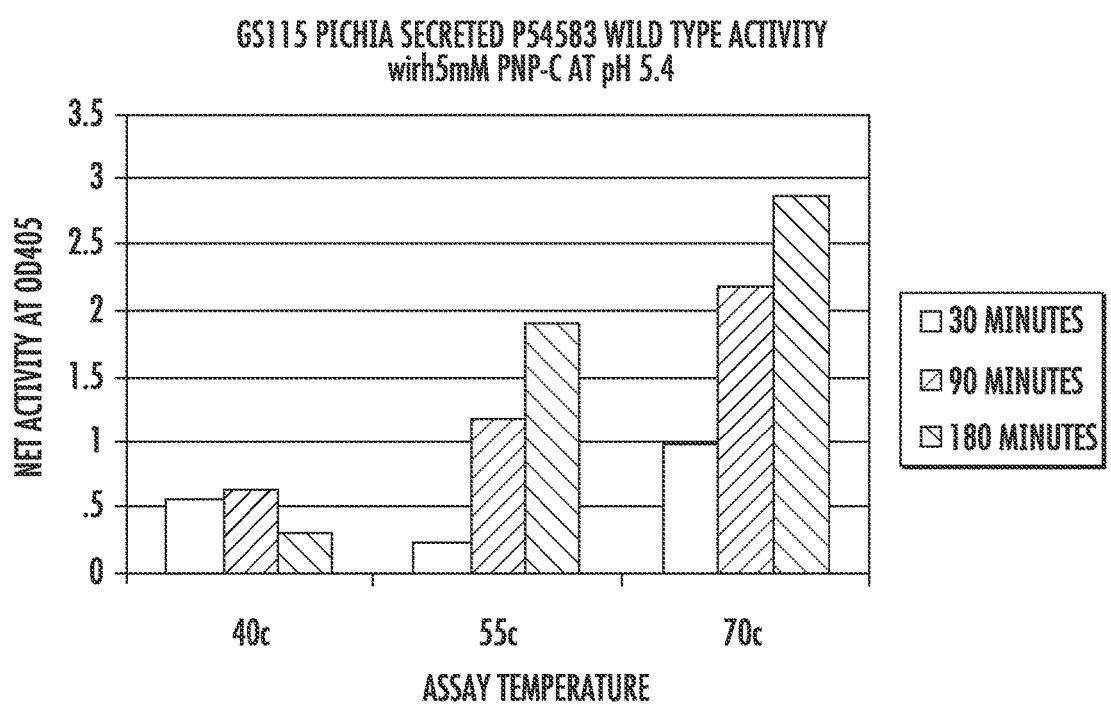
FIG. 10 illustrates a PNP-C assay for P54583.

Cellazyme C tablets are pre-pelleted AZCL-HE cellulose substrate (Megazyme International Ireland, Ltd.). This assay gives results that correlate well with the plate assay. A standard Cellazyme C tablet assay is conducted as follows. Mix a protein sample from liquid culture with 25 mM NaOAc buffer pH4.5 to a final volume of 500 uL. Equilibrate samples to 42° C. for 5 minutes. Add 1 Cellazyme C tablet to each sample and incubate for 30 minutes at 42° C. To stop reaction, add 1 mL 20% tris base. Measure Abs590 in clear flat bottom plate on plate reader. Samples with more endocellulase activity will degrade the substrate more rapidly causing the $Abs_{590}$ to increase. Using this assay, it was determined that P54583 activity is optimal around pH 5.0 and increases up to at least 70° C. Longer duration of assay time will give increased absorbance (590 nm) readings (FIGS. 8 and 9). As shown in FIG. 8, P54583 has increased activity at pH 4.5 to pH 8.0. However there is no significant activity above that of the negative control at pH 2.0. As shown in FIG. 9, the Cellazyme C assay can be used to demonstrate that P54583 activity increases with increased temperature, and the signal intensity (absorbance 590) increases with time. PNP-C liquid assay. Activity from endoglucanases such as P54583 is also detectable with para-nitrophenyl-cellobioside (PNP-C) substrates. A standard PNP-C assay is a 50 ul reaction including 5 mM PNP-C substrate, active enzyme and a buffer to control pH. This assay can be run over a wide range of pH, time, and temperature conditions. To stop the reaction and to amplify the signal intensity, 100 uL of sodium carbonate pH 10.5 is added at a given timepoint. Absorbance at 405 nm ($Abs._{405}$) is measured on a spectrophotometric plate reader. An increase in activity will give a greater reading (FIG. 10). As shown in FIG. 10, a PNP-C assay of P54583 shows that enzyme activity increases with assay temperature.

Enzchek (Invitrogen) Liquid Assay.

Enzchek is a synthetic, fluorometric substrate that is also useful for endoglucanase activity assays. A standard assay involving Enzchek substrate is as follows. Mix equal volumes of room temperature substrate with room temperature enzyme, buffered around pH 5.0, in black well plates (e.g., Corning 384-well black plates #3820) for fluorescence reading. Incubate at room temperature protected from light and measure fluorescence with 340/450 excitation/emission wavelengths. Fluorescence readings increase over time and with more concentrated samples. Readings can be taken without stopping the reaction as early as 5 minutes after the assay begins or after several hours of incubation for samples with low levels of activity. Stopping a reaction makes it possible to perform the reading after the same incubation time, which is useful when processing hundreds or thousands of samples. To stop a reaction, add an equal volume of 20% tris base. This causes an immediate increase in fluorescent reading, which appears consistent between all samples, and is stable for several hours. This activity assay is sensitive, reproducible and can be used for high throughput assays on a liquid handler. Standard liquid handler conditions may be set to 10 ul reactions using total culture, in Corning #3820 plates.

Selection of Yeast Host for Expressing Intein-Modified Endoglucanases.

To test whether alternative yeast hosts might be more suitable for i) mutagenesis and ii) screening clones expressing intein-modified endoglucanases, the abilities of two yeast strains (INVSc-1 (Invitrogen, Carlsbad Calif.) and SCBJ (a.k.a. BJ5465, American Type Culture Collection, Manassas Va., cat. No. 20829)) to take up foreign DNA were compared. Samples of plasmid DNA as either supercoiled or linearized DNA were prepared, and these DNAs were used to transform samples of each cell type with Zymo Research's EZ yeast transformation kit. Table 5, below, shows the relative transformation efficiency of two strains of S. cerevisiae. As shown, transformation efficiency was 100 fold higher with SCBJ than with INVSc1. SCBJ forms noticeable colonies sooner than do INVSc-1 cells.

TABLE 5

| Host | DNA | # of Colonies |
|---|---|---|
| SCBJ | 160 ng linear DNA | 5,000 |
| INVSc-1 | 160 ng linear DNA | 30 |
| SCBJ | Supercoiled plasmid | 7,000 |
| INVSc-1 | Supercoiled plasmid | 50 |

Pull Down Concentration and Purification of Endoglucanases Expressed from Yeasts.

Figure 11:
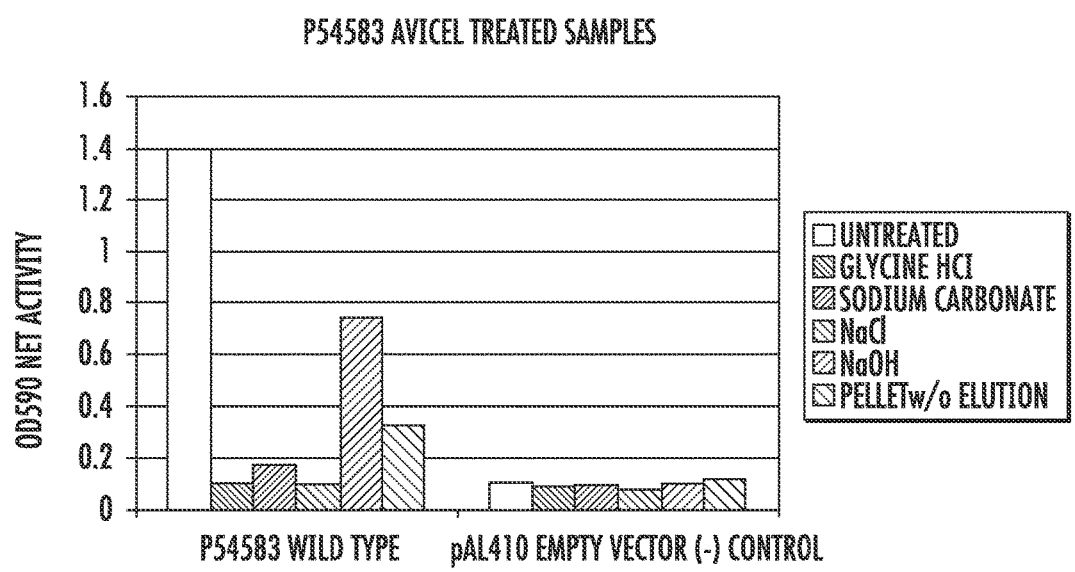
FIG. 11 illustrates purification of P54583 with microcrystalline cellulose.

Common among many endoglucanases, P54583 possesses a C-terminal carbohydrate binding domain that tethers the enzyme to its crystalline substrate. Based on this feature, methods to pull down, and partially purify, endoglucanase with a carbohydrate analog were tested. Six equal aliquots from supernatants of cultures either expressing P54583 or carrying the negative control empty vector (pAL410, FIG. 5) were collected. Avicel™ (microcrystalline cellulose) was added to five aliquots (all but one aliquot, which was saved as the untreated sample). Then, all aliquots were rocked at room temperature for one hour. After incubation, the avicel was pelleted and supernatant was discarded. Four pellets were washed with elution buffers, as indicated in FIG. 11. The eluate was immediately transferred to clean tubes and brought to a neutral pH. The fifth avicel pellet did not receive an elution wash. Activity of all six aliquots was then measured with Cellazyme C tablets. As shown in FIG. 11, microcrystalline cellulose can be used to separate active cellulase out of culture samples. This is a simple, inexpensive, and rapid method for protein purification and concentration of supernatants and cell lysates. Enzyme can then be analyzed by western blot analysis or activity assayed directly from the Avicel™ or eluted to a lesser extent with a variety of buffers.

Immunological Assays.

Figure 12:
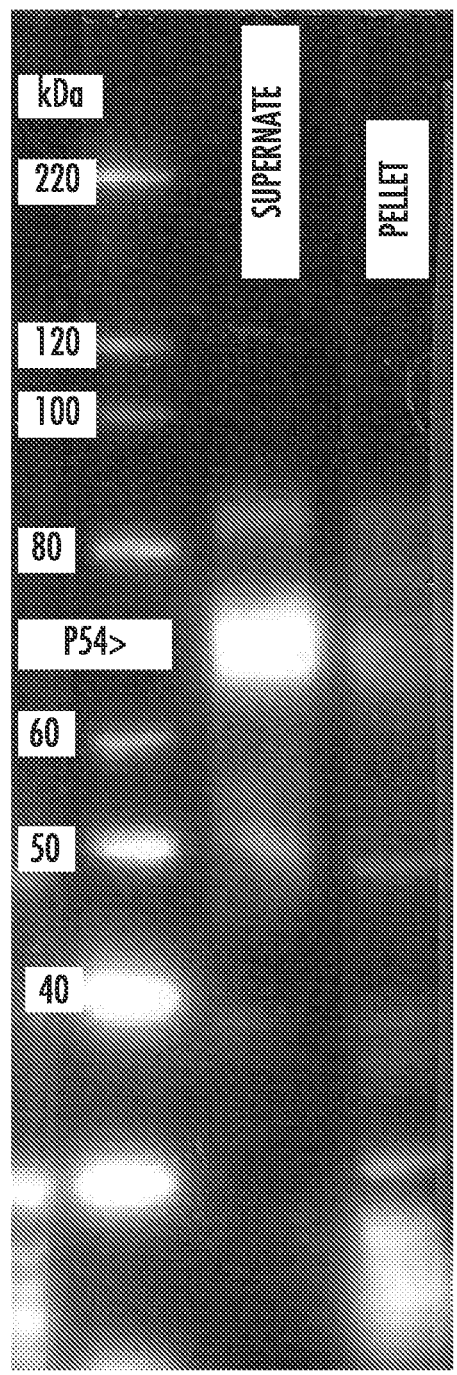
FIG. 12 illustrates western detection of wild type P54583.

P54583 can be detected directly via immunological assays such as western blots. FIG. 12 illustrates the results of a western blot. To conduct the assay, proteins were derived from either culture supernatants or lysates of cell pellets, then deglycosylated prior to electrophoresis. This assay shows that the majority of the detectable protein resides in the culture supernatant which suggests that an antibody-based affinity purification of the enzyme might be useful for protein concentration and purification.

Example 8 —Intein Modification of P54583 Endoglucanase

Figure 13:
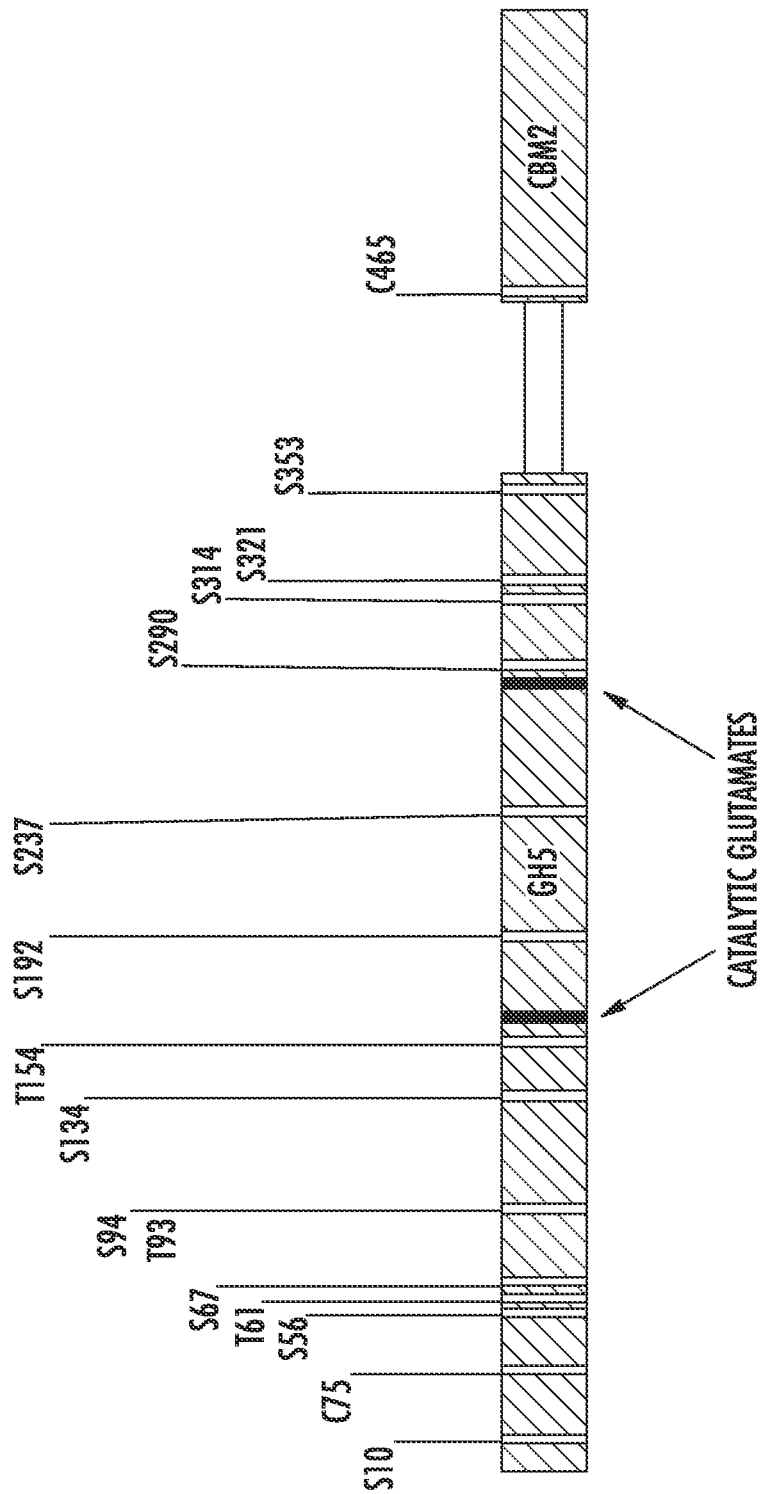
FIG. 13 illustrates candidate intein insertion sites in P54583.

P54583 intein insertion sites were identified by the method set forth in the detailed description. FIG. 13 depicts the relative positions of sites selected in P54583 for insertion of the Tth intein. Relative positions of the catalytic domain (GH5), the linker domain (narrow bar), and the carbohydrate binding module (CBM2) are shown. Two catalytic glutamates are conserved among members of the GH5 family. Numbering of the serine, threonine and cysteines residues shown are all relative to the "mature" form of the polypeptide as it would be secreted from S. cerevisiae following cleavage of the alpha signal peptide, except for C75 and C465, which are actually at position 35 and 425 relative to the cleavage site.

Figure 14:
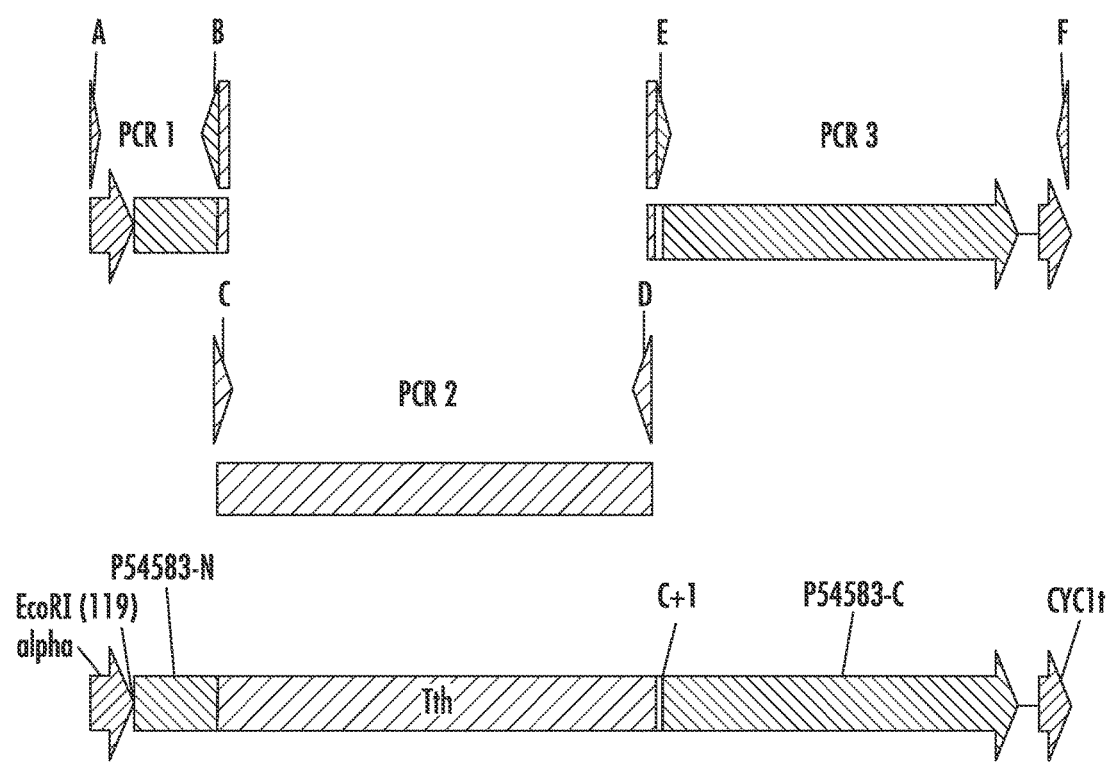
FIG. 14 illustrates an assembly strategy for genes encoding intein-modified endoglucanases.

Coding sequences for the recombinant P54583 proteins were then assembled via an SOE PCR strategy (Horton R M, Hunt H D, Ho S N, Pullen J K, Pease LR. 1989. Engineering hybrid genes without the use of restriction enzymes: gene splicing by overlap extension. Gene. 77(1):61-8), which is incorporated herein in its entirety as if fully set forth) as depicted in FIG. 14. This strategy is similar to that used above in assembling intein-modified xylanase genes. Primers were designed to anneal to:

(A) the sequence encoding the alpha signal peptide in pAL410-P54583 (see FIG. 5);
(B) a region within the coding sequence for P54583 that is adjacent to the insertion site;
(C) the 5' end of the coding sequence for the Tth intein;
(D) the 3' end of the coding sequence for the Tth intein;
(E) a region within the coding sequence for P54583 that is adjacent to the insertion site (note this site does not overlap that covered by primer C); and
(F) a region within the CYC terminator sequence from pAL410 P54583.

PCR1 employed primers A and B to assemble a short product that includes the coding sequences for a portion of the alpha signal factor as well as the N-terminal portion of the endoglucanase (P54583-N). The extreme 3' end of PCR product 1 includes a short segment that is homologous to the extreme 5' end of the Tth intein. PCR2 employs primers C and D to amplify the coding sequence of the Tth intein. PCR3 employs primers E and F to amplify the coding sequences for the C-terminal portion of the endoglucanase (P54583-C, which may include all or a portion of the catalytic domain as well as the carbohydrate binding module) along with the "C+1" amino acid, a short segment that is homologous to the extreme 5' end of the Tth intein, and a portion of the CYC1 terminator (CYC1t) from pAL410 P54583. PCR products 1, 2, and 3 were then combined in a single PCR reaction. By virtue of their homology to the ends of the Tth intein, PCR products 1 and 3 will anneal to PCR product 2. DNA synthesis and amplification with the outermost primers (A and F) will lead to the assembly of the full-length product, as indicated at the bottom of the diagram. The final product is often referred to simply as a "NIC" (N-terminal fragment, an Intein, and a C-terminal fragment). This method may be used to construct an intein modified protein of any type at any insertion site by choosing appropriate primers. And the intein insertion sited can be selected as any amino acid in the protein by utilizing a natural nucleophilic amino acid at the zero position or mutating the amino acid at the zero position to be a nucleophilic amino acid. The nucleophilic amino acid can be a C, T, or S residue.

Typical cycling conditions for SOE PCR involved 20 µl reactions, with 10 µl of Phusion HF (New England Biolabs, Ipswich Mass.) DNA polymerase Master Mix, 4 μl of each primer (from a stock concentration of 1 μM) and 2 μl of the appropriate template, diluted to approximately 0.1-1 ng/μl. Thermal cycling was carried out as recommended by the manufacturers of Phusion HF DNA polymerase. After the initial round of PCR reactions, products were gel purified via the Wizard SV Gel and PCR Cleanup Kit (Promega, Madison, Wis.), and 1 μl from each first round product was mixed to assemble the second round (full-length) product in a subsequent PCR reaction, with conditions virtually identical to the first round, except that extension times were increased from 30s to as much as 60s.

To prepare any desired intein-modified P54583 derivative, PCR products can be prepared that are tailored for each intein insertion position. However, some of the components in this experimental setup are modular. For example, primers C and D can be used to prepare PCR product 2, which can then be used to assemble any of the planned recombinants. Similarly, primers A and F can be used to prepare PCR products 1 and 3, respectively, regardless of the insertion position. As such, only primers B and E are unique to a given intein insertion event. Table 6, below, lists the sequences (in 5'-3' orientation) of the oligonucleotide primers that were used to assemble each of the intein-modified endoglucanases. While primers B and E are unique to each product, each contains a region that is homologous to the terminus of the Tth intein, as presented in the discussion of FIG. 14. This region is underlined in each primer sequence in Table 6.

Insertion of the Tth intein into the C75 position was accompanied by a small number of conservative amino acid changes near the intein/extein junctions. To accommodate these changes, the Tth intein (PCR2) that was used to assemble the C75Tth product was amplified with alternative forms of primers C and D as follows:

$C_{C75Tth'}$
(SEQ ID NO: 1968)
5' TGCCTTGCCGAGGGTACCCGAGTCTTGGACGCGGCTACCGGGCA 3'

$D_{C75Tth'}$
(SEQ ID NO: 1969)
5' GTTGTGCACGACAACCCCTTCGCTCACGAAGTTTGCAAAGGGT 3'

The insertion sites listed in Table 2 are the same as those depicted in FIG. 13. A series of primers were also designed to insert the PspPol and RecA inteins into several positions within P54583. The strategy for inserting these inteins is identical to that described in reference to FIG. 14, except that the sequences of Primers B, C, D, and E are all tailored to the specific intein. The compositions of these primers are shown in Table 7 (primers used to assemble products encoding PspPol intein-modified P54583 endoglucanases) and Table 8 (primers used to assemble products encoding RecA intein-modified P54583 endoglucanases) below.

TABLE 6

```
Primer A    GCTGTTTTGCCATTTTCCAACAGCA(SEQ ID NO: 1934)
Primer C    TGCCTGGCCGAGGGCTCGCTCGTCTTGGACGCGGCTACCG(SEQ ID NO: 1935)
Primer D    GTTATGCACCACCAGGTCCTCGCTCACGAAGTTTGCAAAG(SEQ ID NO: 1936)
Primer F    CCCAAAACCTTCTCAAGCAAGGT(SEQ ID NO: 1937)
```

| Insertion Site | Primer B |
|---|---|
| S10 | AGCGAGCCCTCGGCCAGGCAAGTGTGCCAGTATCCTCCTC (SEQ ID NO: 1938) |
| S56 | AGCGAGCCCTCGGCCAGGCATTTGATCTGGTCGAGCATTG (SEQ ID NO: 1939) |
| C75 | TCGGGTACCCTCGGCAAGGCACGTTTCGAAGCCAAACCA (SEQ ID NO: 1940) |
| T61 | AGCGAGCCCTCGGCCAGGCAATTATACCCCAAGGATTTGA (SEQ ID NO: 1941) |
| S67 | AGCGAGCCCTCGGCCAGGCAGTAGGGCAGCCTAATTGTAT (SEQ ID NO: 1942) |
| T93 | AGCGAGCCCTCGGCCAGGCACAATCCCTGCAGATCCTGGT (SEQ ID NO: 1943) |
| S94 | AGCGAGCCCTCGGCCAGGCAAGTCAATCCCTGCAGATCCT (SEQ ID NO: 1944) |
| S134 | AGCGAGCCCTCGGCCAGGCACACGGAGCTTGTGTACCACA (SEQ ID NO: 1945) |
| T154 | AGCGAGCCCTCGGCCAGGCAGGGGTTGCCTTTATAGCGTT (SEQ ID NO: 1946) |
| S192 | AGCGAGCCCTCGGCCAGGCAGAGAACGGCGTTACCAGCCC (SEQ ID NO: 1947) |
| S237 | AGCGAGCCCTCGGCCAGGCAGTAGACCAGGCGATTCGGAA (SEQ ID NO: 1948) |
| S290 | AGCGAGCCCTCGGCCAGGCACTGAAGAGTGGTGCCAAATT (SEQ ID NO: 1949) |
| S314 | AGCGAGCCCTCGGCCAGGCAATCTGCTCCGTACTGAGCAG (SEQ ID NO: 1950) |
| S321 | AGCGAGCCCTCGGCCAGGCACCAGAACGTCCATTGAAAAG (SEQ ID NO: 1951) |
| S353 | AGCGAGCCCTCGGCCAGGCATTTAATCGGCGCCAAGTACC (SEQ ID NO: 1952) |

| Insertion Site | Primer E |
|---|---|
| S10 | AGGACCTGGTGGTGCATAACTCCGGCAGGGAGATCCTCGA (SEQ ID NO: 1953) |
| S56 | AGGACCTGGTGGTGCATAACTCCTTGGGGTATAATACAAT (SEQ ID NO: 1954) |
| C75 | AGGGGTTGTCGTGCACAACTGTAACTACGTGGTTCACGGCCT (SEQ ID NO: 1955) |
| T61 | AGGACCTGGTGGTGCATAACACAATTAGGCTGCCCTACAG (SEQ ID NO: 1956) |
| S67 | AGGACCTGGTGGTGCATAACAGCGATGACATTCTTAAGCC (SEQ ID NO: 1957) |
| T93 | AGGACCTGGTGGTGCATAACACTTCTCTGCAGGTTATGGA (SEQ ID NO: 1958) |
| S94 | AGGACCTGGTGGTGCATAACTCTCTGCAGGTTATGGACAA (SEQ ID NO: 1959) |
| S134 | AGGACCTGGTGGTGCATAACTCAGAGGCAACATGGATTTC (SEQ ID NO: 1960) |
| T154 | AGGACCTGGTGGTGCATAACACGGTTGTGGGATTCGACCT (SEQ ID NO: 1961) |
| S192 | AGGACCTGGTGGTGCATAACAGCGTCAATCCCAACTTGCT (SEQ ID NO: 1962) |
| S237 | AGGACCTGGTGGTGCATAACTCAGCACACGACTACGCGAC (SEQ ID NO: 1963) |
| S290 | AGGACCTGGTGGTGCATAACTCGACGACAGACCAAACCTG (SEQ ID NO: 1964) |
| S314 | AGGACCTGGTGGTGCATAACTCTTTTCAATGGACGTTCTG (SEQ ID NO: 1965) |
| S321 | AGGACCTGGTGGTGCATAACTCTTGGAATCCTGACTCCGG (SEQ ID NO: 1966) |
| S353 | AGGACCTGGTGGTGCATAACAGCTCGATCTTTGACCCAGT (SEQ ID NO: 1967) |

TABLE 7

| Primer A | GCTGTTTTGCCATTTTCCAACAGCA (SEQ ID NO: 1970) |
|---|---|
| Primer C | AGCATTTTACCGGAAGAATGGGT (SEQ ID NO: 1971) |
| Primer D | ATTATGTGCATAGAGGAATCCA (SEQ ID NO: 1972) |
| Primer F | CCCAAAACCTTCTCAAGCAAGGT (SEQ ID NO: 1973) |

| Insertion Site | Primer B |
|---|---|
| C75 | ACCCATTCTTCCGGTAAAATGCTCGTTTCGAAGCCAAACCA (SEQ ID NO: 1974) |
| S56 | ACCCATTCTTCCGGTAAAATGCTTTTGATCTGGTCGAGCATTGA (SEQ ID NO: 1975) |
| S94 | ACCCATTCTTCCGGTAAAATGCTAGTCAATCCCTGCAGATCCT (SEQ ID NO: 1976) |
| S237 | ACCCATTCTTCCGGTAAAATGCTGTAGACCAGGCGATTCGGA (SEQ ID NO: 1977) |
| S290 | ACCCATTCTTCCGGTAAAATGCTCTGAAGAGTGGTGCCAAATTCA (SEQ ID NO: 1978) |
| S353 | ACCCATTCTTCCGGTAAAATGCTTTTAATCGGCGCCAAGTACCCGT (SEQ ID NO: 1979) |
| C465 | ACCCATTCTTCCGGTAAAATGCTCCTAGCCCCGCTCGCTGCGGT (SEQ ID NO: 1980) |

| Insertion Site | Primer E |
|---|---|
| C75 | TGGATTCCTCTATGCACATAATTGTAACTACGTGGTTCACGGCCT (SEQ ID NO: _1981) |
| S56 | ACCCATTCTTCCGGTAAAATGCTTTTGATCTGGTCGAGCATTGA (SEQ ID NO: 1975) |
| S94 | TGGATTCCTCTATGCACATAATTCTCTGCAGGTTATGGACAAGATCGT (SEQ ID NO: 1983) |
| S237 | TGGATTCCTCTATGCACATAATTCAGCACACGACTACGCGA (SEQ ID NO: 1984) |
| S290 | TGGATTCCTCTATGCACATAATTCGACGACAGACCAAACCT (SEQ ID NO: 1985) |
| S353 | TGGATTCCTCTATGCACATAATAGCTCGATCTTTGACCCAGT (SEQ ID NO: 1986) |
| C465 | TGGATTCCTCTATGCACATAATTGCACCGCTTCTTACCAGGT (SEQ ID NO: 1987) |

TABLE 8

| Primer A | GCTGTTTTGCCATTTTCCAACAGCA (SEQ ID NO: 1988) |
|---|---|
| Primer C | TGCCTTGCCGAGGGTACCCGAaTCTTCGA (SEQ ID NO: 1989) |
| Primer D | GTTGTGCACGACAACCCCTTCGGCGA (SEQ ID NO: 1990) |
| Primer F | CCCAAAACCTTCTCAAGCAAGGT (SEQ ID NO: 1991) |

| Insertion Site | Primer B |
|---|---|
| C75 | TCGGGTACCCTCGGCAAGGCACGTTTCGAAGCCAAACCA (SEQ ID NO: 1992) |
| S56 | TCGGGTACCCTCGGCAAGGCATTTCATCTGGTCGAGCATTGA (SEQ ID NO: 1993) |
| S94 | TCGGGTACCCTCGGCAAGGCAAGTCAATCCCTGCAGATCCT (SEQ ID NO: 1994) |
| S237 | TCGGGTACCCTCGGCAAGGCAGTAGACCAGGCGATTCGGA (SEQ ID NO: 1995) |
| S290 | TCGGGTACCCTCGGCAAGGCACTGAAGAGTGGTGCCAAATTCA (SEQ ID NO: 1996) |
| S353 | TCGGGTACCCTCGGCAAGGCATTTAATCGGCGCCAAGTACCCGT (SEQ ID NO: 1997) |
| C465 | TCGGGTACCCTCGGCAAGGCACCTAGCCCCGCTCGCTGCGGT (SEQ ID NO: 1998) |

| Insertion Site | Primer E |
|---|---|
| C75 | AGGGGTTGTCGTGCACAACTGTAACTACGTGGTTCACGGCCT (SEQ ID NO: 1999) |
| S56 | AGGGGTTGTCGTGCACAACTCCTTGGGGTATAATACAATTAGGCT (SEQ ID NO: 2000) |
| S94 | AGGGGTTGTCGTGCACAACTCTCTGCAGGTTATGGACAAGATCGT (SEQ ID NO: 2001) |
| S237 | AGGGGTTGTCGTGCACAACTCAGCACACGACTACGCGA (SEQ ID NO: 2002) |
| S290 | AGGGGTTGTCGTGCACAACTCGACGACAGACCAAACCT (SEQ ID NO: 2003) |
| S353 | AGGGGTTGTCGTGCACAACAGCTCGATCTTTGACCCAGT (SEQ ID NO: 2004) |
| C465 | AGGGGTTGTCGTGCACAACTGCACCGCTTCTTACCAGGT (SEQ ID NO: 2005) |

Using the above primers, SOE PCR reactions were carried out for all of the intein-modified endoglucanases that were designed. Full-length PCR products were then ligated into pCRBlunt II TOPO (Invitrogen) and individual clones were fully sequenced to ensure that no unintended base changes had occurred during PCR and/or cloning. In cases where mutations were discovered, all or parts of the affected PCR reactions were repeated and errors were corrected. Once the composition of a product encoding an intein modified P54583 was confirmed, the entire fragment was excised from the pCRBlunt II vector and ligated into pAL410 (or a related vector). The resulting vectors were subsequently introduced into yeast cells. Yeast transformants were typically verified via a combination of colony PCR and plasmid recovery via miniprep (using reagents from the ZymoPrep Yeast Miniprep Kit II, Zymo Research, Orange Calif.). Plasmids recovered from yeast cells were then re-introduced into E. coli cells, propagated, isolated via E. coli plasmid miniprep and examined via restriction enzyme digestion to determine whether the plasmids had suffered any mutations or rearrangement since their introduction into the original yeast cells. When fully verified plasmids were recovered in this manner, the corresponding yeast strain would be used in subsequent experiments involving the intein-modified endoglucanase.

Figure 15:
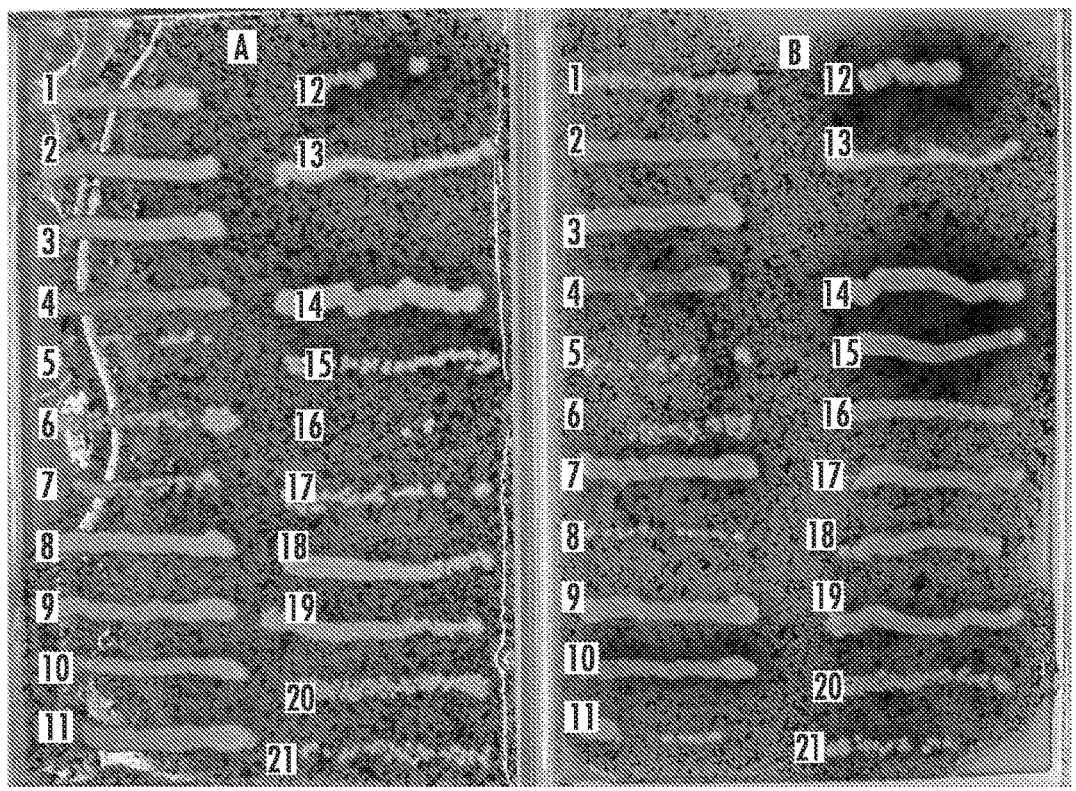
FIG. 15 illustrates scoring of intein-modified endoglucanases behavior in response to different temperature treatments.

S. cerevisiae transformants carrying expression vectors for intein modified endoglucanases were then scored onto parallel YPD plates (A and B) containing 100 mg/L G418 onto which an overlay of 0.2% AZCL-HE-cellulose had been applied. These plates were incubated for 2 nights at 30° C. Then plate B was moved to 70° C. for several hours. FIG. 15 shows plates A and B and in respective order, streaks 1-21 are P54583 T154Tth, P54583 S135Tth, P54583 S134Tth, P54583 S96Tth, P54583 S94Tth, P54583 T93Tth, P54583 C75Tth, P54583 S67Tth, P54583 T61Tth, P54583 S56Tth, P54583 S10Tth, P54583-Wild Type, pAL410 empty vector, P54583 S393Tth, P54583 S353Tth, P54583 S330Tth, P54583 S321Tth, P54583 S314Tth, P54583 S277Tth, P54583 S237Tth, and P54583 S192, which have the sequences of SEQ ID NOS: 1753-1758, 1741, 1759, 1760, 1739, 1761, 111, 2006, 1762-1767, 1743 and 1742, respectively. Blue halos appear around some of the cells, indicating the presence of P54583 activity. Results from this experiment suggested that insertion of the Tth intein disrupts P54583 to varying degrees, depending on the insertion site, and that one or more of these intein-modified endoglucanases displays temperature-sensitive enzyme activity.

Figure 16:
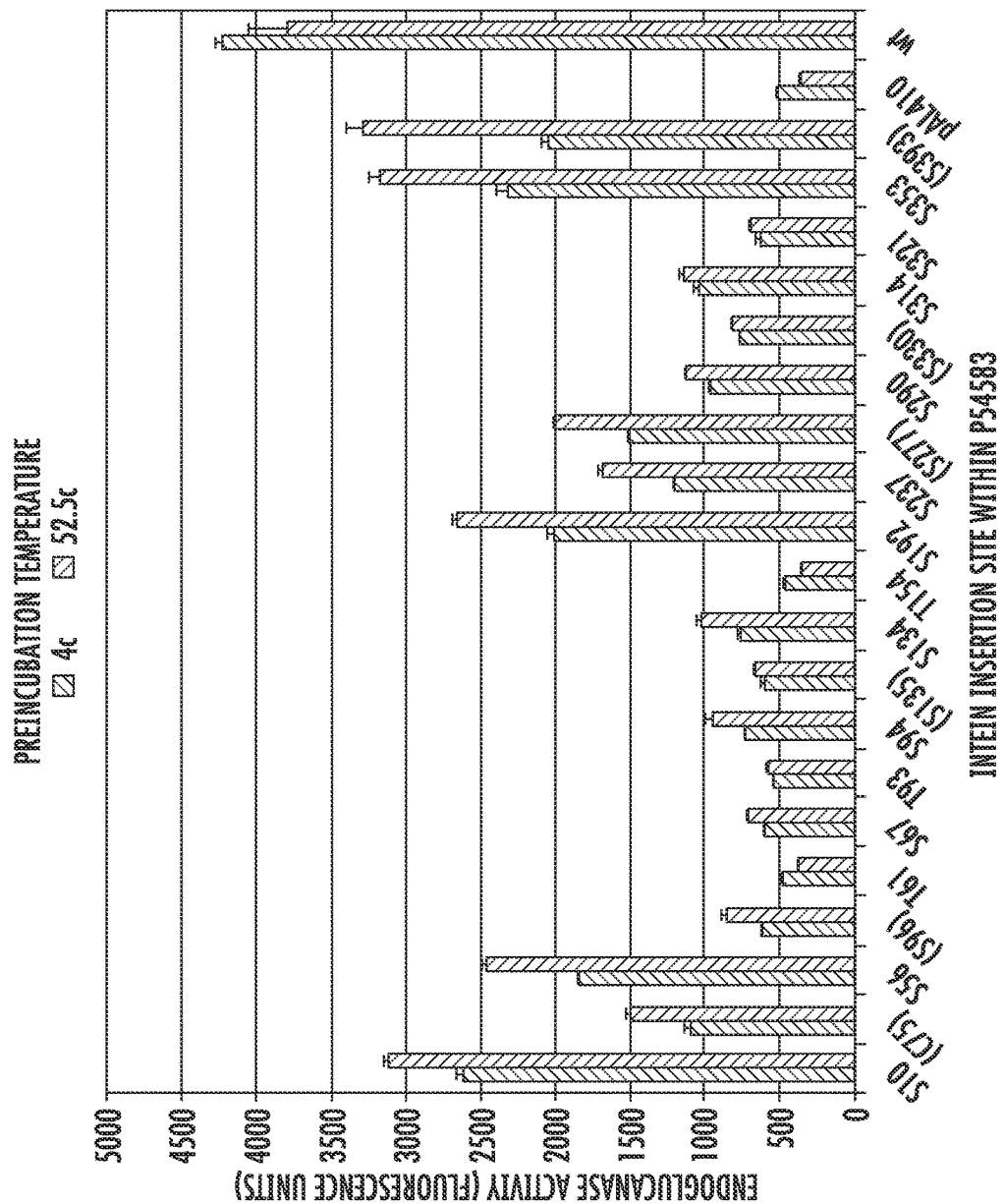
FIG. 16 illustrates intein modified endoglucanases activity assays.

Inserting Tth intein into P54583 wild type has an effect on the enzyme expression and activity levels, which can be measured by western analysis and activity assays. An Enzchek activity assay was run on 20 P54583 NICs with controls. The 20 NICS had the Tth intein inserted in the S10, S56, T61, S67, (C75), T93, S94, (S96), S134, (S135), T154, S192, S237, S290, S314, S321, S353, and (S393) positions. These 20 NICS have the sequence of (SEQ ID NOS: 1761, 1739, 1760, 1759, 1741, 1758, 1757, 1756, 1755, 1754, 1753, 1742, 1743, 1768, 1766, 1765, 1763, and 1762). Culture supernatant was divided into aliquots. Half of these aliquots were subjected to heating pretreatment at 52.5° C. for 6 hours while the other half were stored at 4° C. Temperature and duration of pretreatment may vary. These samples were then equilibrated to room temperature and subjected to an Enzchek assay (3 hour incubation time with the substrate). At the end of the assay, endoglucanase activity was inferred from the amount of fluorescence in each sample. As shown in FIG. 16, the Enzchek activity assay revealed that a subset of the intein-modified endoglucanases produce enzyme activity above the background (pAL410, empty vector control), and that a portion of these show higher activity still when pre-incubated at 52.5° C. In FIG. 16, wt means wild type P54583 endoglucanase. Because of the difference in numbering used among constructs (reflecting either the immature or the mature form of P54583 lacking its signal peptide) the amino acid position of the insertion site relative to the immature form is presented in parentheses for a subset of the NICs.

Figure 17:
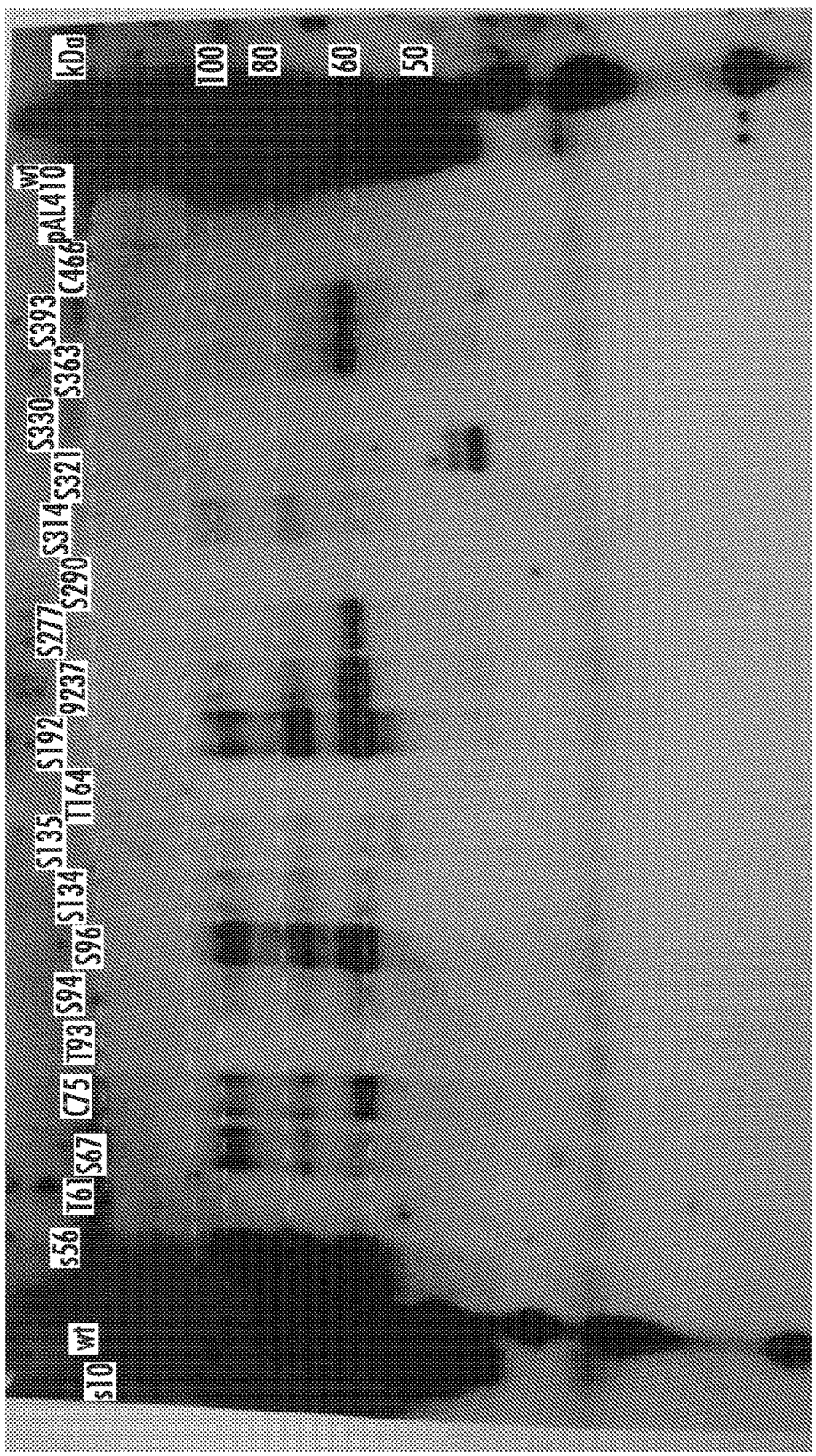
FIG. 17 illustrates a western blot analysis of various intein modified P54583 proteins.

The constructs described in FIG. 16 contain a His tag on the carboxyl end which can be detected by a His tag antibody. Supernatants from corresponding cultures were concentrated 20-fold, and used in western blot assays (FIG. 17). In FIG. 17, wt indicates the P54583 wild type, pAL410 indicates the empty vector with the His antibody (Genscript, Piscataway N.J.), and mature spliced protein appears as a 60 kDa band. An additional Tth intein modified P54583, C465 (SEQ ID NO: 1769) was also assayed by western blot, as shown in FIG. 17. Lanes marked with an asterisk also show significant activity on plate assay (See FIG. 15). Western blots showed that proteins with molecular weights similar to that of the wild type enzyme could be detected in cultures expressing intein-modified enzymes, suggesting that intein splicing is occurring in the recombinant proteins. Higher molecular weight species could also be detected in several samples, which may correspond to unspliced NICs, splicing intermediates, aggregates, or other forms of the recombinant proteins. The NICs showed varying levels of protein accumulation, which corresponds to the activity measurements presented in FIG. 16 to some extent.

Example 9—Mutagenesis of Intein Modified Endoglucanases

Homologous recombination has been used to generate tremendous diversity among DNA libraries in *S. cerevisiae* (Swers J S, Kellogg B A, Wittrup K D. 2004, Shuffled antibody libraries created by in vivo homologous recombination and yeast surface display, Nucleic Acids Res. 32:e36, which is incorporated by reference herein in its entirety as if fully set forth). In this system, linear DNAs carrying the coding sequences for polypeptides that have been generated can be inserted into linearized expression vectors by co-transformation into yeast. Error-prone PCR or other strategies can be used to mutagenize all of an intein-modified endonuclease or portions thereof (e.g., the intein). The resulting products can be co-transformed into *S. cerevisiae* cells along with a suitable linearized expression vector (e.g., pAL410 or a derivative thereof), which will catalyze homologous recombination between the molecules and give rise to collections of several thousand yeast clones, each carrying a unique recombinant expression vector. Yeast colonies that arise from such an in vivo recombination protocol can thus express a variety of modified proteins whose diversity is directly related to (or even greater than) the level to which the coding sequence has been mutagenized.

A series of recombination vectors for use in yeast in vivo recombination were developed. The recombination vectors each carry a truncated version of the Tth intein. The truncated Tth inteins lack most of the intein sequence, retaining only 70-80 bp from each of the 5' and 3' ends of the intein coding sequence. At the center of this DNA sequence is a unique EcoRV recognition site. The DNA sequence of the truncated Tth is shown below, with the EcoRV site underlined.

(SEQ ID NO: 2007)
TGCCTGGCCGAGGGCTCGCTCGTCTTGGACGCGGCTACCGGGCAGAGGGT

CCCTATCGAAAAGGTGCGTCCGGG<u>GATATC</u>GAACCGGCCGGTAAGGCGAG

AACATTCGACTTGCGCGTTCCACCCTTTGCAAACTTCGTGAGCGAGGACC

TGGTGGTGCATAAC

Expression vectors that carry such a truncated intein can be easily linearized via EcoRV digestion. Since such vectors lack most of the "wild type" intein sequence, the expression vectors that arise during homologous recombination in yeast are more likely to carry the mutations generated during error-prone PCR since there is less "wild type" intein to compete with the mutants during recombination. Furthermore, the use of this truncated intein in the recombination vector provides the added benefit of decreasing the number of false positives that might arise due to vector self-ligation in a high throughput screening regime. Because of the nature of the truncation, the truncated inteins introduce a frameshift into the endoglucanase gene, resulting in an enzyme whose translation would be prematurely terminated. Such translation products are less likely to be enzymatically active. As such, functional enzymes that arise during screening of libraries are more likely to result from true recombination events involving DNA fragments encoding mutagenized inteins.

Using a strategy similar to that described in reference to FIG. 14, expression vectors derived from pAL410-P54583noHis were prepared. In these expression vectors, the truncated Tth intein sequence was introduced in place of the full-length inteins in either the S56, C75, 5192, or 5237 positions. This collection of recombination vectors was then used to generate mutagenized libraries of mutagenized intein-modified endoglucanases in yeast SCBJ cells. Referring to FIGS. 18A-C, a PCR intein mutagenesis scheme is illustrated. Primers (e.g., S237up and S237down) flanking the intein insertion site in the template expression vector (pAL410-P54583noHis S237Tth (FIG. 18A)) can be used to amplify a specific region of the recombinant vector that contains the entire intein coding sequence as well as portions of the flanking extein coding sequences. Alternatively, primers that amplify only intein sequences can be used. Under appropriate conditions, PCR products were generated with random mutations scattered among the collection of amplified DNA molecules (stars). These mutagenized DNA molecules can be mixed with an appropriate vector, as shown in FIG. 18C that has been linearized via digestion with EcoRV restriction endonuclease. The mixture can then be introduced into yeast cells to drive recombination. In the example above, the DNA molecules depicted in (B) would be used to create a library of mutagenized inteins in the S237 position using linearized pAL410-P54583noHis S237Tth-trunc as the vector. Primers tailored for the S56, C75, or S192 positions can similarly be used in conjunction with the respective recombination vectors depicted in FIG. 18C. Such a strategy permits the inclusion of DNA molecules that carry mutations in the flanking regions of the extein (in this example, a endoglucanase) as well as within the intein. However, if PCR primers are used that amplify only intein sequences during error prone-PCR, then any of the recombination vectors can be used to host the altered intein coding sequences. In FIG. 18A, P54583-N and P54583-C refer to the coding sequences for the N and C-terminal portions of the endoglucanase. In FIG. 18B, P54583* refers to small flanking portions derived from the endoglucanase coding sequences that can be included in the mutagenized PCR product with judiciously designed primers. In FIG. 18C, TthN and TthC denote the N- and C-terminal portions of the Tth coding sequence that are separated by the EcoRV site in the truncated intein. Other abbreviations are as described in reference to FIG. 5.

Example 10—P54583 Modified with Mini-Inteins

Figure 19:
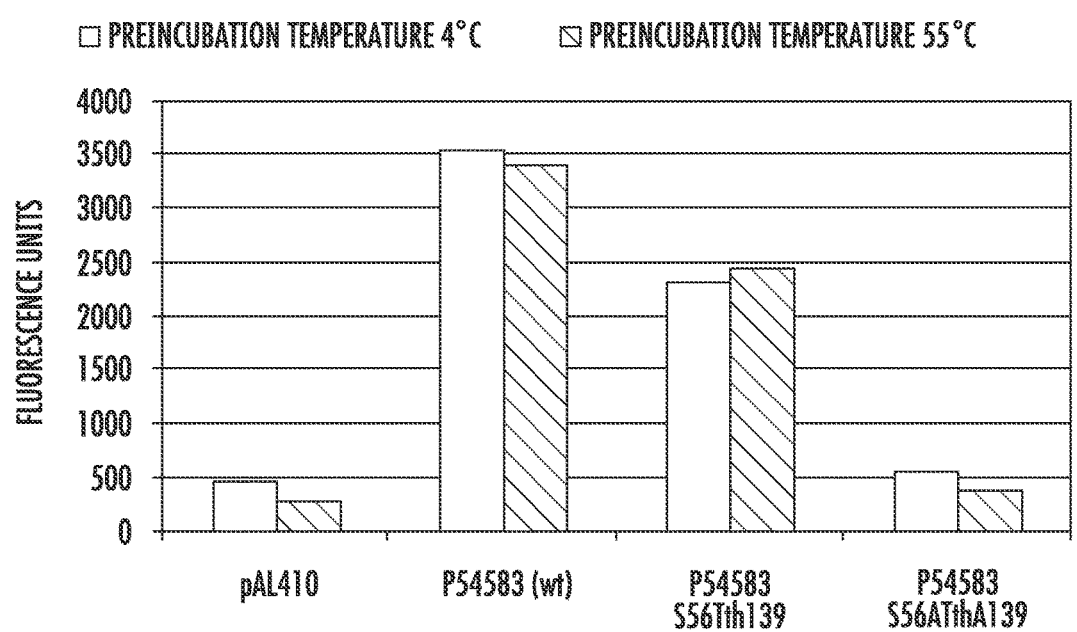
FIG. 19 illustrates the effect of a crippled intein on enzyme activity in P54583.

Based on initial plate and liquid activity assays, a subset of the insertion sites described above were chosen to modify with an additional eight mini Tth inteins, which are mTth001 (SEQ ID NO:92), mTTh002(SEQ ID NO:93), mTth003 (SEQ ID NO:94), mTth004(SEQ ID NO:95), mTth005(SEQ ID NO:96), mTth007(SEQ ID NO:98), mTth008(SEQ ID NO:99), and mTth010(SEQ ID NO:101). One intein was inserted per construct. The S56 position in P54583 was the initial site chosen for modification with mini-inteins. In a single yeast in vivo recombination reaction, the mini-Tth inteins were inserted into this position. Following recovery and growth of the yeast on YPD G418 plates, 36 separate colonies were cultured for activity assay. Two of the 36 expressed activity above baseline levels. Plasmids were recovered from these two strains and subjected to DNA sequence analysis. Both samples were found to carry the mTth010 mini-intein. The DNA sequence of the MTth010 mini-intein is shown below with the corresponding amino acid sequence beneath:

To test whether the endoglucanase activity of the P54583 derivative carrying this mini-intein (a.k.a. "P54583 S56 mTth010") was dependent upon the ability of the mini-intein to splice, a modified version of the construct was prepared. In the modified version, the terminal amino acids of the intein (the cysteine residue at the N-terminus and the asparagine residue at the C-terminus; see the sequence above) were replaced with alanines. The N-terminal cysteine and the C-terminal asparagine likely play critical roles in catalyzing intein splicing, and substitutions of these residues with alanine are either known to or are likely to prevent intein splicing. Referring to FIG. 19, samples were removed from SCBJ yeast cultures carrying either the empty expression vector, pAL410 (negative control), an expression vector encoding the uninterrupted enzyme, P54583 (wt), an expression vector encoding a derivative carrying the mini-intein in the S56 position, P54583 S56Tth139, or an expression vector encoding a derivative carrying the crippled mini-intein in the S56 position, P54583 S56AThA139. The samples were assayed for endoglucanase activity via a four hour incubation at room temperature in the Enzchek assay. Unlike the mini-intein, the crippled intein reduces endoglucanase activity nearly to the level of the negative control. This trend was consistent regardless of whether the samples had been pre-incubated at low (4° C.) or high (55° C.) temperatures for 6 hours prior to the assay. From this, it was concluded that the inability to splice a mini-intein in the S56 position of P54583 will disrupt enzyme activity, while a splicing-competent mini-intein in the same position will permit reconstitution of much of the enzyme's native activity.

Figure 20:
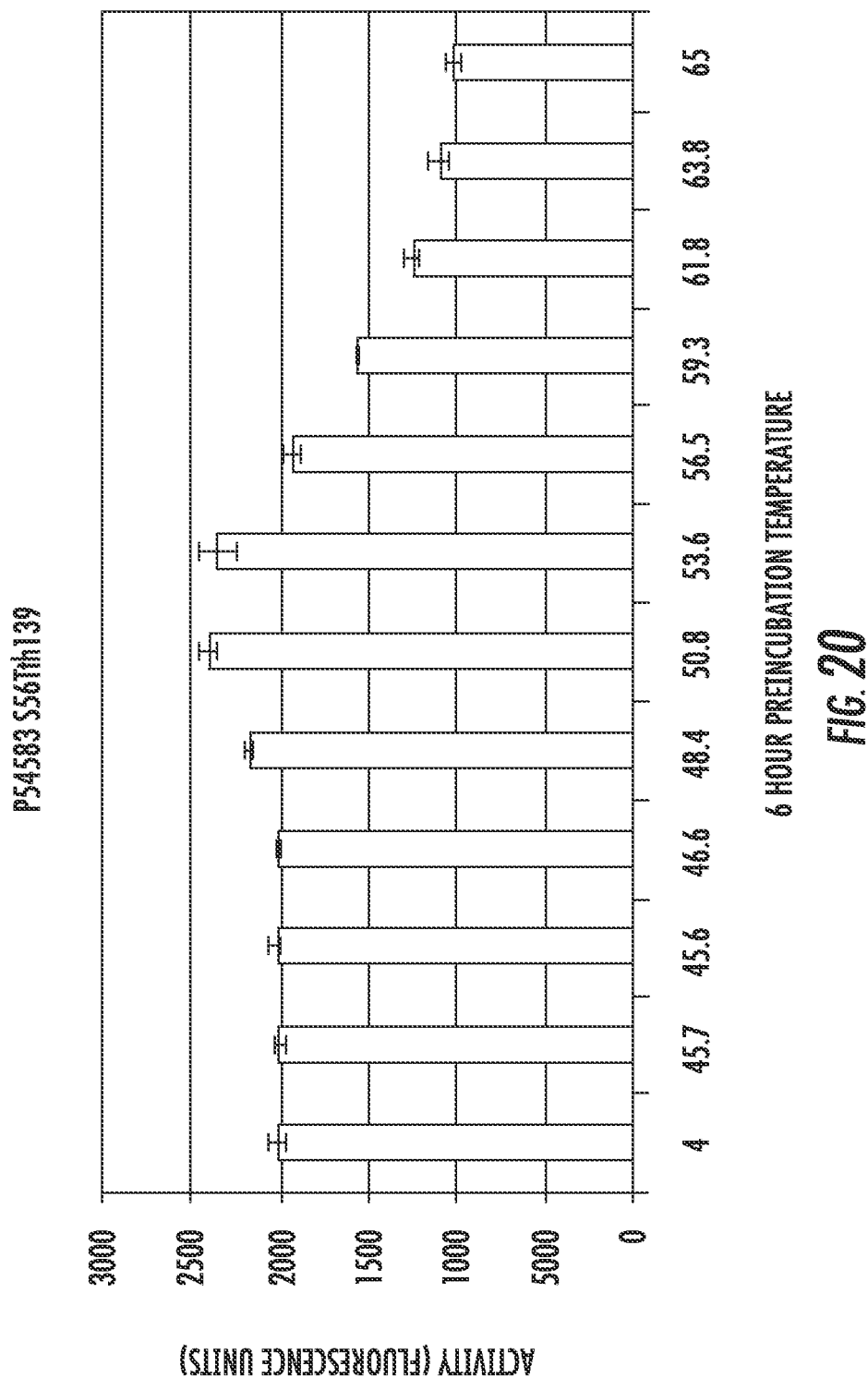
FIG. 20 illustrates enzyme activity recovery by pre-incubation at various temperatures.

To investigate whether the mini-intein in this position showed temperature-sensitive splicing, that is, whether pre-incubation of the recombinant enzyme at particular temperatures reconstituted different amounts of endoglucanase activity, samples from a single culture of SCBJ yeast cells expressing P54583 S56MTth010 (a.k.a. P54583 S56Tth139) were pre-incubated six hours at various temperatures. After this period, the samples were cooled uniformly to 4° C. and then subjected to the standard Enzchek assay (room temperature incubation with substrate). Referring to FIG. 20, preincubation temperatures as high as 46.6° C. reconstituted no more activity than did preincubation at 4° C. However, preincubation of the enzyme for 6 hours at 50.8-53.6° C. led to modest increases in enzyme activity. At higher tempera-

```
                              mTth010 tgcctggccgagggctcgctcgtcttggacgcggctaccgggcagagggtccctatcgaa
  C   L   A   E   G   S   L   V   L   D   A   A   T   G   Q   R   V   P   I   E aaggtgcgtccggggatggaagttttctccttgggacctgattacagactgtatcgggtg
  K   V   R   P   G   M   E   V   F   S   L   G   P   D   Y   R   L   Y   R   V cccgttttggaggtccttgagagcggggttagggaagttgtgcgcctcagaactcggtca
  P   V   L   E   V   L   E   S   G   V   R   E   V   V   R   L   R   T   R   S gggagaacgctggtgttgacaccagatcacccgcttttgaccccgaaggttggaaacct
  G   R   T   L   V   L   T   P   D   H   P   L   L   T   P   E   G   W   K   P ctttgtgacctcccgcttggaactccaattgcagtcagagatgttgagactggagaggtt
  L   C   D   L   P   L   G   T   P   I   A   V   R   D   V   E   T   G   E   V ctctgggacccta ttgttgctgtcgaaccggccggtaaggcgagaacattcgacttgcgc
  L   W   D   P   I   V   A   V   E   P   A   G   K   A   R   T   F   D   L   R gttccacccctttgcaaacttcgtgagcgaggacctggtggtgcataac   (SEQ ID NO: 2008)
  V   P   P   F   A   N   F   V   S   E   D   L   V   V   H   N    (SEQ ID NO: 101)
``` tures, the endoglucanase activity appeared to drop below the levels attained by enzymes that had not been heated above 4° C. At least in part this decrease in apparent activity may be due to the loss of a background "endoglucanase-like" activity that can be detected in yeast culture supernatants. The background activity is heat labile at such elevated temperatures. When total endoglucanase activity is slow (as in this particular experiment), the effect of this background activity can be significant. To some extent, the effect of this phenomenon can be seen in the data depicted in FIG. 19 where the endoglucanase "activity" of the negative control s ample (pAL410) appears to decrease when the culture is preincubated at 55° C. prior to the assay. FIG. 20 shows that a temperature between 50.8° C. and 53.6° C. leads to the reconstitution of the greatest amount of activity from this recombinant enzyme.

Figure 21:
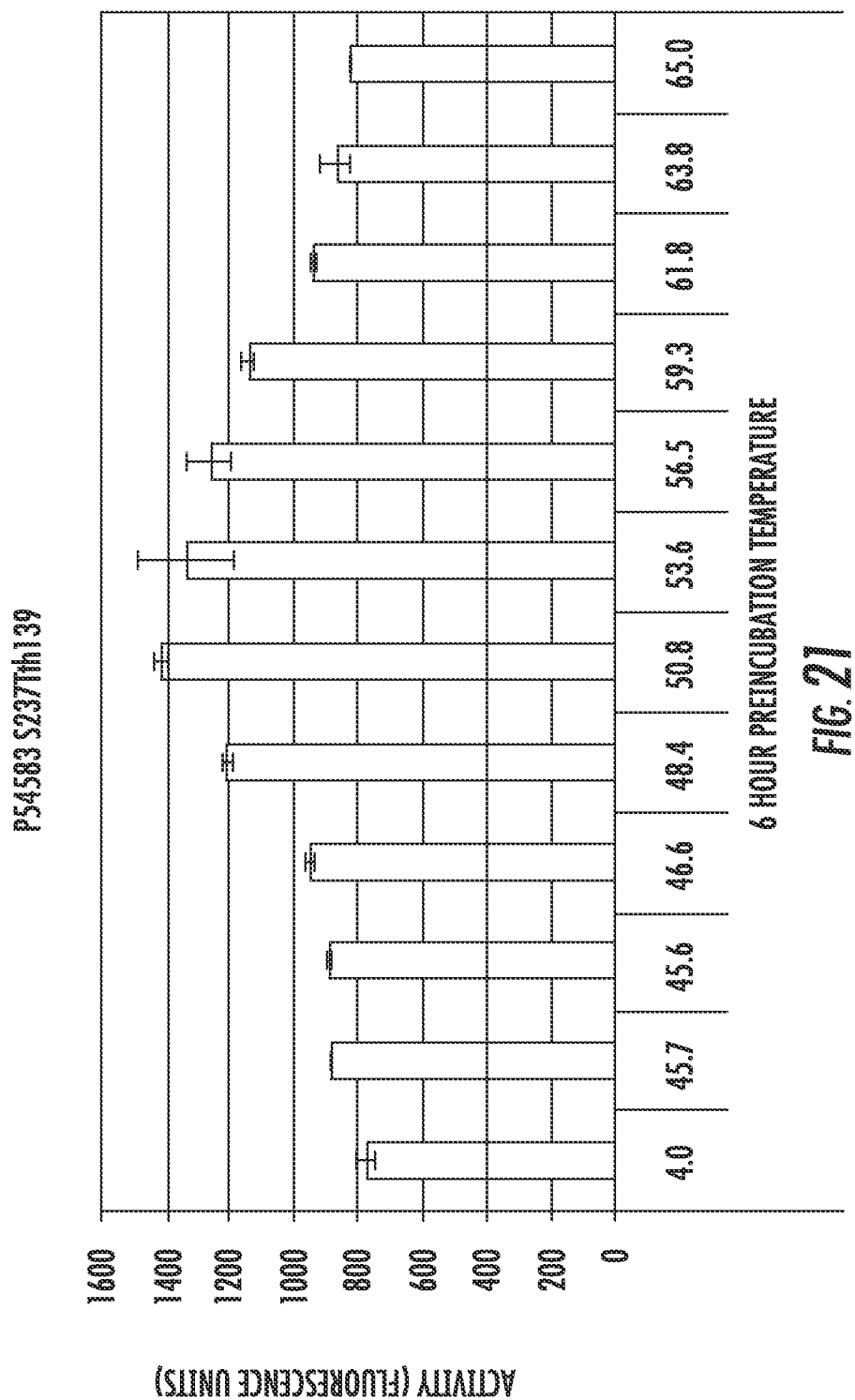
FIG. 21 illustrates enzyme activity recovered from P54583 carrying a mini-intein in the 5237 position after pre-incubation at different temperatures.

Eight mini-inteins were introduced into the S237 position of P54583. The eight mini-inteins had the sequence of SEQ ID NOS: 2009-2016, respectively. One intein was inserted per construct. The mini-inteins were introduced into the S237 position via in vivo recombination. Candidate recombinant yeast colonies were recovered in each case, and the plasmids that each carried were isolated and tested via DNA sequencing to confirm whether the gene responsible for the intein-modified endoglucanase was intact, and lacking point mutations or other changes. Once a yeast strain had been identified for each of the mini-intein-modified endoglucanases, the entire set was subjected to endoglucanase assays. Strains carrying the mTth010 mini-intein demonstrated clear endoglucanase activity. As shown in FIG. 21, this intein-modified endoglucanase also showed an optimum induction temperature near 52.5 C.°. Preincubation of the enzyme for 6 hours at 50.8-53.6° C. led to an increase in enzyme activity of approximately 75%. Assays were carried out at room temperature for 1 hour using the Enzchek substrate. Additional P54583-mTth010-5237 intein modified proteins that were isolated and showed improved activity levels are given as SEQ ID NOS: 1751, 1752.

Figure 22:
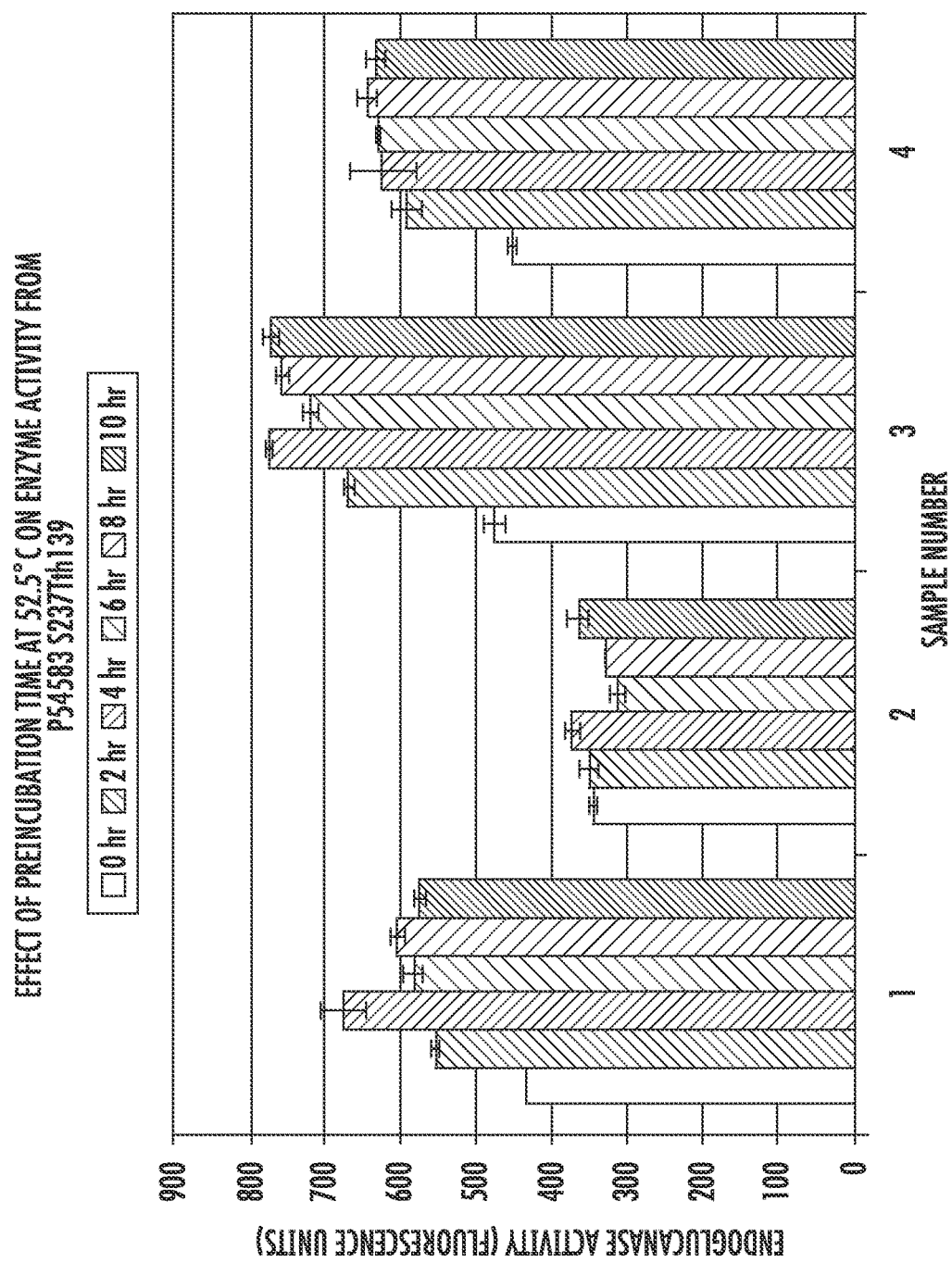
FIG. 22 illustrates pre-incubation time and intein-modified endoglucanase activation. Each panel (1, 2, 3 and 4) includes bars representing 0, 2, 4, 6, 8 and 10 hour pre-incubation presented from left to right.

Having shown that mTth010 activity could be recovered from the P54583 S237MTth010 intein-modified endoglucanase by pre-incubation at approximately 52.5° C., it was then tested whether the length of this pre-incubation step influenced enzyme activity. Four separate colonies from a culture of SCBJ (pAL410 P54583noHis S237Tth139) were cultured independently in a rich medium. Aliquots were sampled from each culture, split into multiple samples, and each split sample pre-incubated for different lengths of time at 52.5° C. as follows: 0 hours (not heated, pre-incubated only at 4° C.), 2 hours, 4 hours, 6 hours, 8 hours, or 10 hours. Following the pre-incubation step, individual split samples were stored at 4° C. until assays were carried out. Each split sample was then assayed via the Enzchek assay at room temperature. As shown in FIG. 22, three of the four cultures tested achieved their highest level of activation within 2-4 hours. Longer pre-incubation times either did not improve enzyme activation or caused a decrease in the amount of activity recovered.

Example 11—Mutagenesis and Screening of Intein-Modified Endoglucanases

Using the strategies outlined in reference to FIG. 18, error-prone PCR was used to create collections (libraries) of mutants carrying base pair alterations in the DNA encoding the inteins and adjacent portions of the endoglucanase. Libraries were prepared that are derivatives of both full-length and mini-inteins in each of several positions in P54583, including the S56, C75, S192, and 5237 positions. Yeast clones from each library were collected for preliminary analysis. Colony PCR (Using KAPA2G Robust Taq from KAPA Biosystems, Waltham Mass.) was used to amplify the portion of the endoglucanase-encoding gene that included the mutagenized intein in each case. These PCR products were then subjected to DNA sequencing to assess the frequency and nature of the mutations in the library.

Figure 23:
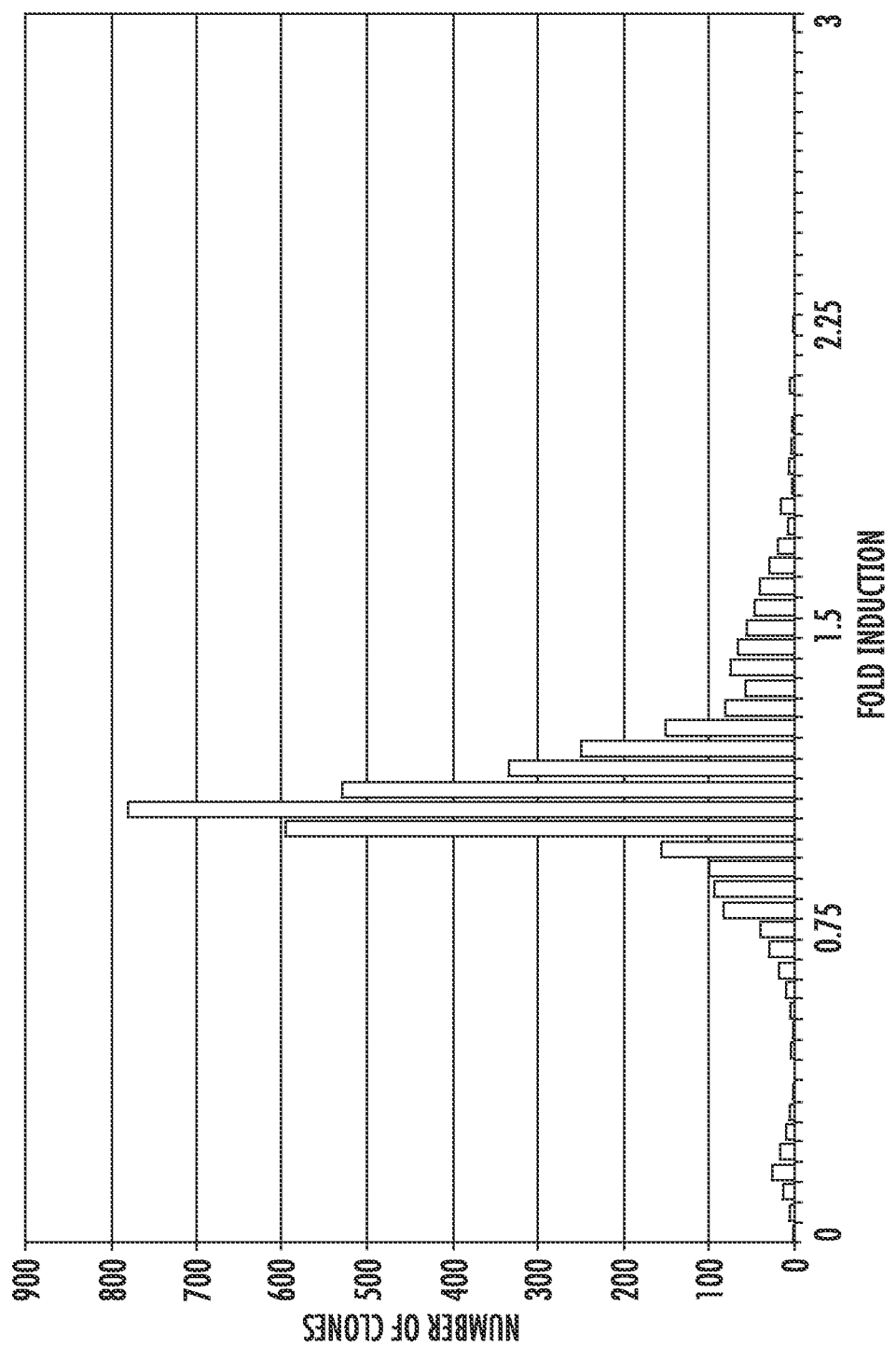
FIG. 23 illustrates high throughput endoglucanase assay results for an intein modified endoglucanase library.

Following the initial assessment of mutation frequencies, clones from an individual library were spread onto selective media (YPD agar supplemented with 100 mg/L G418) and grown at 30° C. for 2-3 days. 3760 colonies were picked from these plates, along with a number of positive [SCBJ (pAL410 P54583noHis)] and negative [(SCBJ(pAL410)] controls, and inoculated into 1 ml volumes of YPD liquid medium supplemented with 100 mg/L G418 that had been dispensed into deep, 96-well plates. These cultures were then incubated for 3 days with vigorous shaking at 30° C. Aliquots were then removed from each of the liquid cultures, divided into replicate samples, and subjected to the Enzchek assay. For each culture, a portion of the replicate samples were pre-incubated at 52.5° C. for 4 hours, while the remainder were incubated at room temperature. Afterward, all replicate samples were equilibrated to room temperature, and split into triplicate samples prior to mixing with the Enzchek substrate. After 90 minutes, the endoglucanase reaction was halted by the addition of an equal volume of 20% tris base, and total fluorescence units were measured. The degree of heat-sensitive enzyme activation was inferred from the difference in activity measured from the heated and unheated treatments for each sample. The difference in activity that each clone displayed across the two pretreatment conditions was then calculated as a fold induction where 1-fold denoted no change in activity. Degrees of heat-sensitive increase (or decrease) in enzyme activity were then binned, and the number of clones falling into each category plotted in the histogram of FIG. 23. As shown in FIG. 23, the diversity of behaviors (temperature-sensitivity) among clones from the library is centered on the behavior of the parental clone, in this case the P54583 endoglucanase carrying the MTth010 mini-intein in the S56 position, which also displayed an increase in activity of ~10% (i.e., 1.1-fold induction; cf. FIG. 23) when pre-incubated at about 52.5° C.

Figure 24:
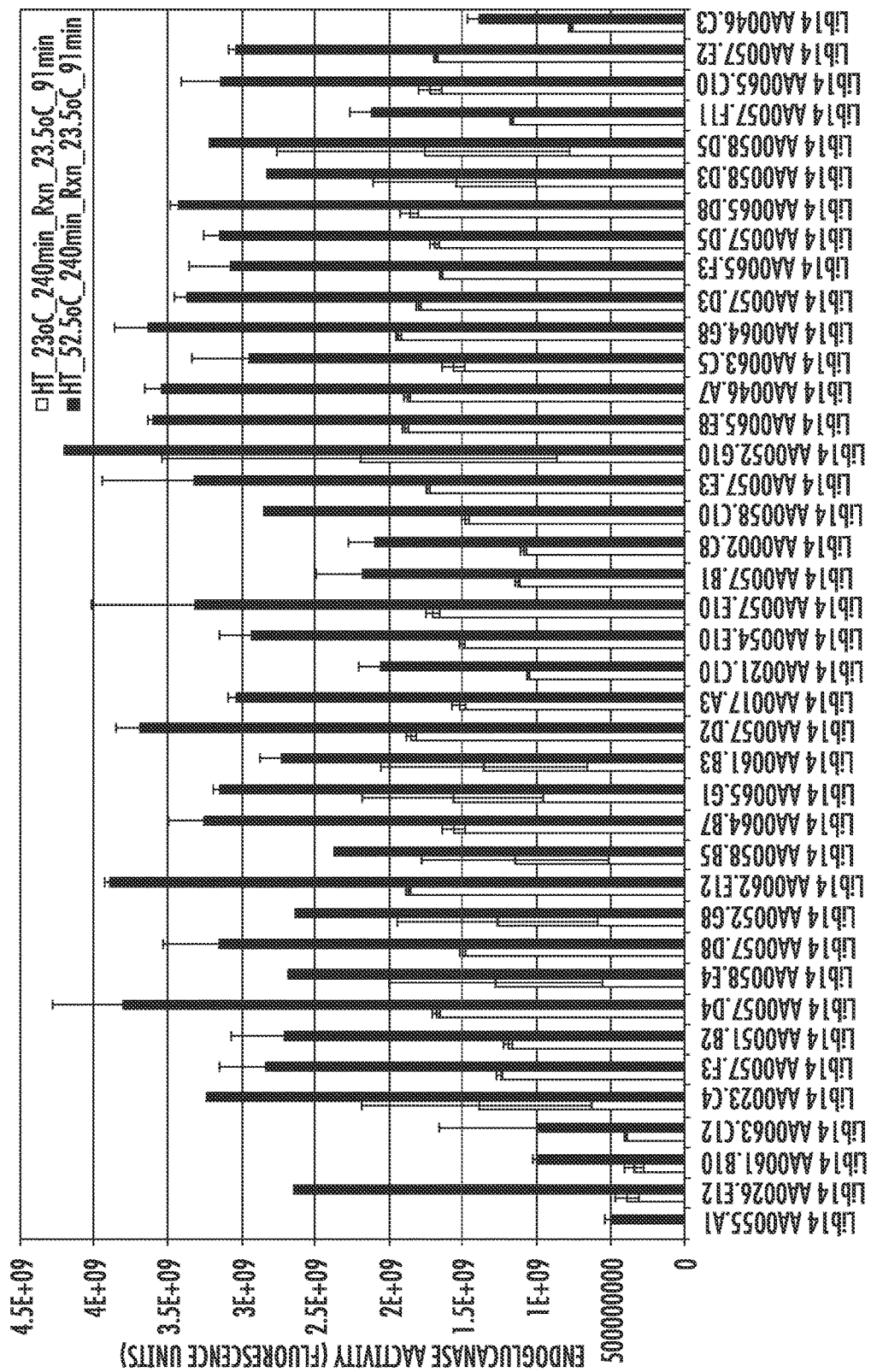
FIG. 24 illustrates of a mutagenized intein modified endoglucanase library screen.

Ranking the degree of temperature-sensitivity among these nearly 4000 clones permitted identification of candidates for further analysis. Clones from a library designated "Library 14" (Lib14, SCBJ cells carrying derivatives of pAL410 P54583 S56Tth139) were analyzed. Clones that showed the greatest difference in activity in the experiment described in reference to FIG. 23 were further analyzed, and a portion of the data is shown in the chart of FIG. 24. Selected clones include the mutant intein modified enzymes indicated in Table 9, below. The activity from room temperature-treated samples is indicated by the left bar for each mutant, and the activity from heat treated samples is indicated by the right bar for each mutant of FIG. 24. Error bars in FIG. 24 reflect the differences in activity among triplicate assays. In these assays, the wild type P54583 positive controls and the pAL410 negative controls typically displayed modest decreases in activity following pre-incubation at the elevated temperature. As such, none of these control samples appear in FIG. 24 among the 40 clones showing the greatest increase in activity.

TABLE 9

| MUTANT | SEQUENCE |
| --- | --- |
| AA0002.C8 | SEQ ID NO: 1745 |
| AA0021.C10 | SEQ ID NO: 1746 |
| AA0057.F3 | SEQ ID NO: 1747 |
| AA0057.D5 | SEQ ID NO: 1748 |
| AA0063.C5 | SEQ ID NO: 1749 |
| AA0064.B7 | SEQ ID NO: 1750 |

Figure 25:
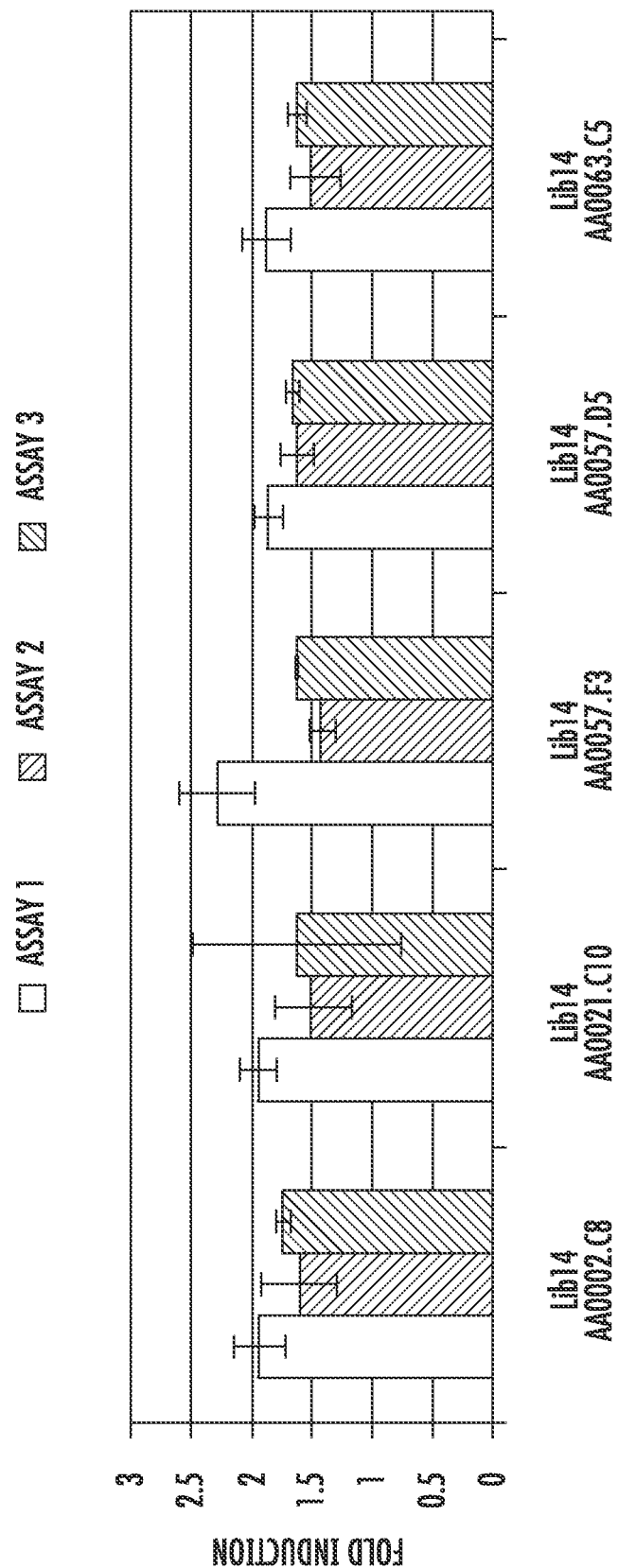
FIG. 25 illustrates repeated activity assays on candidates from a mutagenized intein modified endoglucanase library.

Individual clones were collected from the above set and colony purified. Fresh cultures (in YPD G418) were grown from 3 single colonies derived from each clone, and these cultures were subjected to the Enzchek assay for temperature-sensitivity endoglucanase activity, constituting a second assay of the above candidates. Subsequently, a colony from one of the 3 single colonies that had been used for the second assay was used to inoculate 3 separate 1 ml volumes of YPD G418, grown at 30° C., and tested via the Enzchek assay, constituting a third assay of the above candidates. In each case, the fold increase in activity was calculated, making it possible to determine the reproducibility of the performance of each clone. Such a comparison is shown in FIG. 25 for six of the clones collected from this library. In FIG. 25, Assay 1 refers to the initial result with each clone from the high-throughput screening. The data from this assay correspond to a single culture from which 6 technical replicates (3 pre-heated, 3 unheated) were generated and assayed. Data from Assay 2 reflects 3 biological samples (single cultures derived from 3 separate colonies), from which duplicate samples were prepared (one pre-heated, one unheated), which were each then split into two technical replicates prior to the assay. Assay 3 reflects results with cultures derived from single colonies purified from the initial cultures that had been examined during Assay 1. In Assay 3, the results are averages of a minimum of 12 assays (6 pre-incubated at room temperature and 6 pre-incubated at 52.5° C.), with each set of 6 corresponding to two technical replicates for each of a minimum of three biological replicates. These results suggest that the initial screen may slightly overstate the degree of change in activity that can be recovered from a given clone, although each of the candidates shown in FIG. 25 showed ≥1.5-fold induction in subsequent assays.

Portions of the DNA sequences encoding the intein-modified endoglucanases were isolated by colony PCR from several of the candidates identified in the original screening of Library 14. An examination of the sequences of the intein-coding regions from each clone presented in FIG. 25 showed that each carried a mutation that caused at least one amino acid change within the sequence of mini intein MTth010, and one of the clones also had a mutation that resulted in an amino acid change in the adjacent N-extein sequence. These mutations are listed in Table 10, below.

TABLE 10

| Original Clone Designation | Amino Acid Changes in MTth010* | Amino Acid Changes in P54583† |
| --- | --- | --- |
| Lib14 AA0002.C8 | L66S | |
| Lib14 AA0021.C10 | P104L | |
| Lib14 AA0057.F3 | R55C | |
| Lib14 AA0057.D5 | R55C | |
| Lib14 AA0063.C5 | E27K | P21S |
| Lib14 AA0064.B7 | L86V | |

*Numbering relative to that of MTth010
†Numbering relative to the mature form of P54583 endoglucanase In the examples summarized in Table 10, only the regions in the immediate vicinity of the intein were sequenced. It is interesting to note, however, that two independent clones were recovered with the same mutation in the intein (R55c in both Lib14 AA0057.F3 and Lib14 AA0057.D5).

Figure 26:
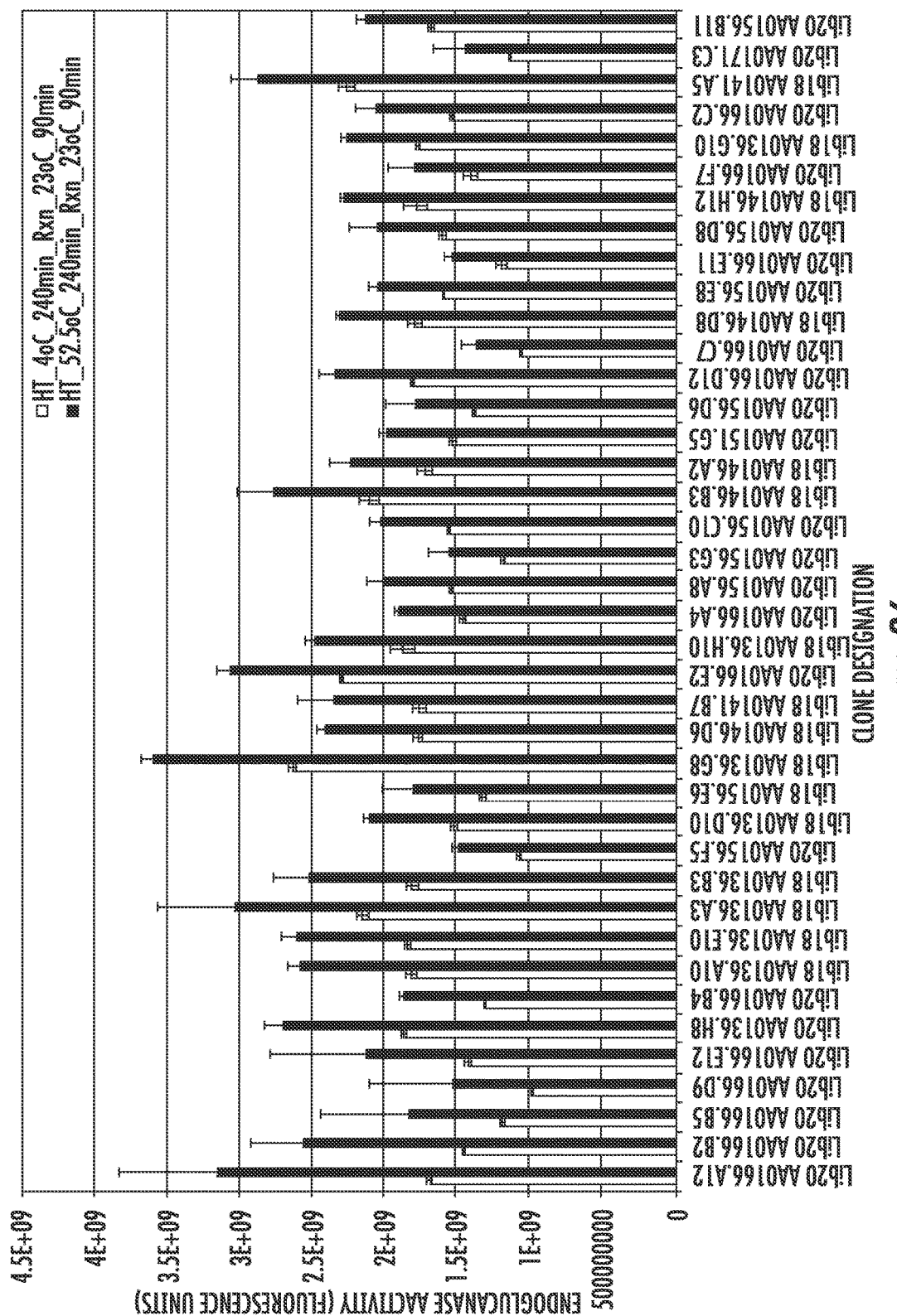
FIG. 26 illustrates heat-inducible enzyme activity from intein modified endoglucanases carrying mutations in the R51 position of the Tth intein.

Additional libraries were constructed in which a single amino acid within the full-length Tth intein was targeted for saturating mutagenesis. Previous results with intein mutagenesis in a xylanase (SwissProt accession number P77853) revealed that mutations that affected arginine 51 of the intein when Tth was inserted into certain positions of P77853 gave the intein-modified xylanase a strong temperature-sensitivity switching phenotype. To test whether a similar mutation might cause a temperature-sensitive behavior in intein-modified endoglucanases, we introduced random mutations at the R51 position of the Tth intein, where the inteins were carried in either the S56, C75, 5192, or S237 positions of P54583. Libraries of yeast clones expressing intein-modified endoglucanases with these mutations were then screened with the same high-throughput Enzchek assay described above. Data were sorted to identify those clones that expressed enzymes with the strongest temperature-sensitive induction. As shown in FIG. 26, candidates arising from this screen showed modest (1.5 to 2-fold) induction in activity upon pretreatment. The majority of the best performers were derived from those clones that carried the inteins in either the 5192 or the S56 positions of P54583.

Example 11a

Following saturating mutagenesis at discrete positions within P54583 S237Tth139 NIC (a.k.a. P54583-S237MTth010), high-throughput screening of *S. cerevisiae* cultures expressing individual recombinant proteins identified several candidates with improved switching relative to control proteins. Plasmid DNAs were recovered from individual yeast clones. Sequencing of portions of these plasmids identified the mutations in each of the corresponding genes. Translation of the mutant sequences showed that the proteins they encode carried one or more amino acid changes relative to the starting NIC. These changes are listed in Table 10A below.

TABLE 10A

| | | Mutations* | | |
| --- | --- | --- | --- | --- |
| Plasmid Number | Candidate | N-extein aa 1-236 | intein aa 1-136 | C-extein aa 237-522 |
| 4 | GS.95 AB0111.A1 | | P89V | |
| 5 | GS.83 AA8745.E11 | | E76I | |
| 6 | GS.74 AA8723.H12 | | L84R | |
| 19 | GS.92 AB0191.B4 | L145I | G87V | A520V |
| 24 | GS.114 AA9891.E8 | | A114R | |
| 33 | GS.111 AB0836.A8 | | P110V | |
| 42 | GS.NX3 AB0158.H5 | L234A | | A520V |
| 43 | GS.NX1 AB1285.F2 | N232K | | A520V |
| 44 | GS.102 AB2963.H8 | | E99K, W102Y | A520V |
| 45 | GS.NX1 AB1285.C9 | N232K | | A520V |
| 46 | GS.NX4 AB0142.H6 | V235S | | A520V |
| 47 | GS.NX2 AB0152.G8 | R233G | | A520V |
| 48 | GS.101 AB2956.G5 | | L101R | A520V |
| 49 | GS.NX1 AB1294.A1 | N232K | | A520V |
| 50 | GS.NX1 AB1285.G9 | N232C | | A520V |
| 51 | GS.NX1 AB1294.H3 | N232L | | A520V |
| 52 | GS.NX3 AB0157.A2 | L234G | | A520V |
| 53 | GS.NX1 AB1282.C5 | N232S | | A520V |
| 54 | GS.NX1 AB1285.E10 | N232W | | A520V |
| 55 | GS.NX2 AB2999.E1 | R233L | | A520V |
| 56 | GS.NX1 AB1285.B4 | N232V | | A520V |
| 57 | GS.NX2 AB2999.G4 | R233S | | A520V |
| 58 | GS.NX1 AB1285.G7 | N232M | | A520V |

TABLE 10A-continued

| Plasmid Number | Candidate | Mutations* | | |
|---|---|---|---|---|
| | | N-extein aa 1-236 | intein aa 1-136 | C-extein aa 237-522 |
| 59 | GS.NX1 AB1285.F4 | N232A | | A520V |
| 60 | GS.NX1 AB1282.E4 | N232V | | A520V |
| 61 | GS.101 AB2956.G4 | | L101M | A520V |
| 62 | GS.NX1 AB1294.F8 | N232S | | A520V |
| 63 | GS.NX4 AB0143.G8 | V235G | | A520V |
| 64 | GS.103 AB0162.F5 | | D103V | |
| 66 | GS.88 AB0311.E12 | L145I | G87V | A520V |

*Numbering of the amino acids in the exteins is relative to that of the parent enzyme, P54583. Numbering of amino acids in the intein is independent of that of the exteins.

Figure 26A:
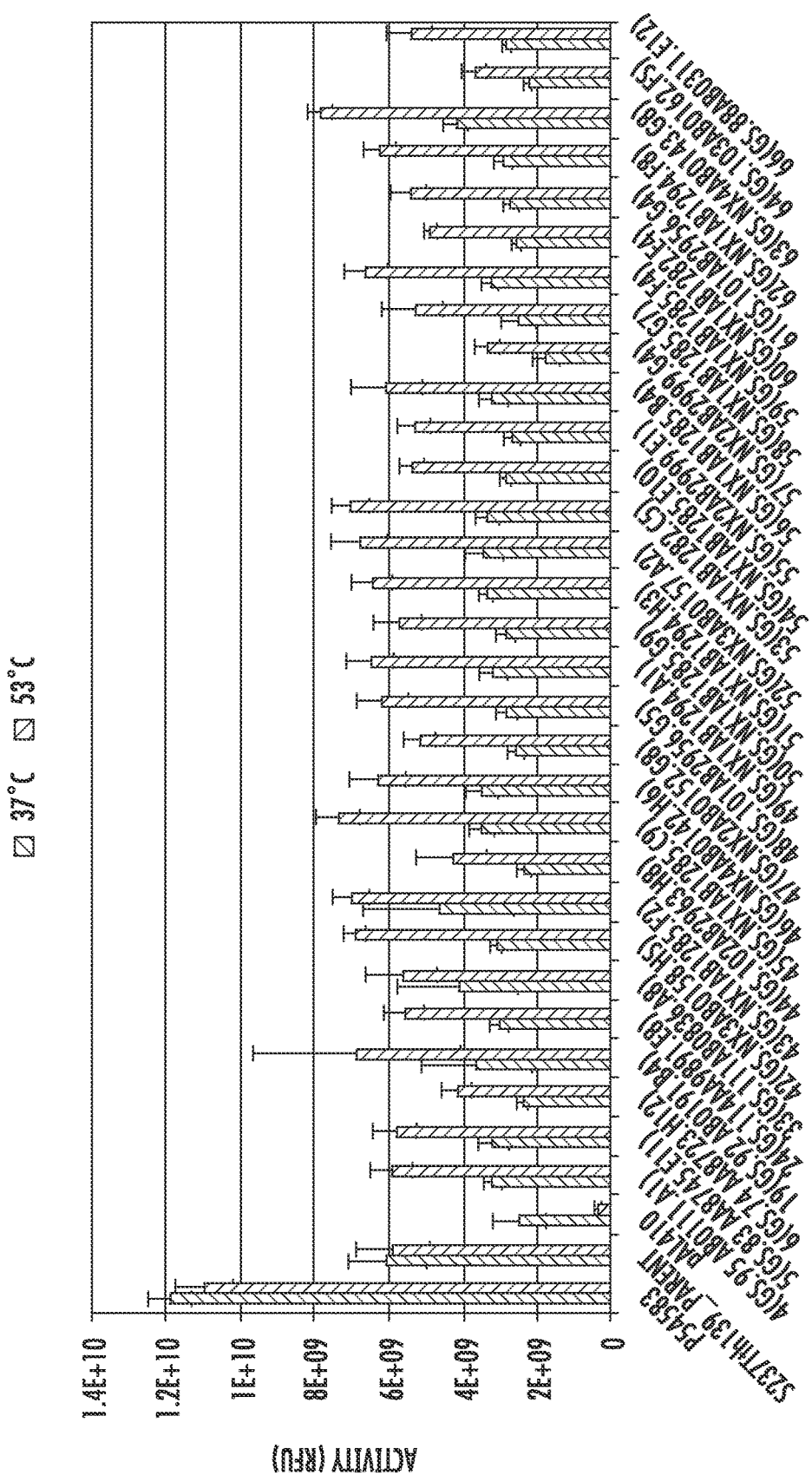
FIG. 26A summarizes activity assays results for the clones of Example 11a using 4-methylumbelliferyl cellobioside.

The results from the activity assays for each of these clones using 4-methylumbelliferyl cellobioside are summarized in FIG. 26A.

A minimum of 8 S. cerevisiae colonies representing each candidate were inoculated into 800 μl YPD+300 mg/l G418 and grown for 4 days at room temperature with shaking. The resulting cultures were split into 4 replicate 5 μl aliquots. Two of these aliquots were then preincubated at 37° C. for 5 hours and two were incubated at 53° C. for 5 hours. All aliquots were then cooled overnight to 4° C., the assayed at room temperature for endoglucanase activity using 4-MUC as the substrate. Averages with standard deviations across all replicate cultures and samples for each clone under each preincubation condition are shown in FIG. 26A. The wild type enzyme (P54583) shows very little change in activity, regardless of the preincubation temperature. The parent NIC (P54583 S237Tth139) has lower overall activity and, in this assay, showed very little change in response to the preincubation conditions. The negative control samples (carrying only the plasmid vector, pAL410) showed a marked decrease in their residual activity after preincubation at 53° C. Most of the candidates in this set showed high activity after preincubation at 53° C.

The following are the sequences of the inferred NIC polypeptides encoded on each of the plasmids that were isolated from the clones above. The underlined sequences (and the corresponding number) refer to the intein.

```
Parent NIC P54583 S237Tth139
                                             (SEQ ID NO: 2059)
MAGGGYWHTSGREILDANNVPVRIAGINWFGFETCNYVVHGLWSRDYRSMLDQIKSLGYN    60

TIRLPYSDDILKPGTMPNSINFYQMNQDLQGLTSLQVMDKIVAYAGQIGLRIILDRHRPD   120

CSGQSALWYTSSVSEATWISDLQALAQRYKGNPTVVGFDLHNEPHDPACWGCGDPSIDWR   180

LAAERAGNAVLSVNPNLLIFVEGVQSYNGDSYWWGGNLQGAGQYPVVLNVPNRLVYCLAE   236/4

GSLVLDAATGQRVPIEKVRPGMEVFSLGPDYRLYRVPVLEVLESGVREVVRLRTRSGRTL    64

VLTPDHPLLTPEGWKPLCDLPLGTPIAVRDVETGEVLWDPIVAVEPAGKARTFDLRVPPF   124

ANFVSEDLVVHNSAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK   344

DGYLAPIKSSIFDPVGASASPSSQPSPSVSPSPSPSPSPSASRTPTPTPTPTASPTPTLTPT   404

ATPTPTASPTPSPTAASGARCTASYQVNSDWGNGFTVTVAVTNSGSVATKTWTVSWTFGG   464

NQTITNSWNAAVTQNGQSVTARNMSYNNVIQPGQNTTFGFQASYTGSNAAPTVACAAS    522

P54583-mTth010-S237-4
                                             (SEQ ID NO: 2060)
MAGGGYWHTSGREILDANNVPVRIAGINWFGFETCNYVVHGLWSRDYRSMLDQIKSLGYN    60

TIRLPYSDDILKPGTMPNSINFYQMNQDLQGLTSLQVMDKIVAYAGQIGLRIILDRHRPD   120

CSGQSALWYTSSVSEATWISDLQALAQRYKGNPTVVGFDLHNEPHDPACWGCGDPSIDWR   180

LAAERAGNAVLSVNPNLLIFVEGVQSYNGDSYWWGGNLQGAGQYPVVLNVPNRLVYCLAE   236/4

GSLVLDAATGQRVPIEKVRPGMEVFSLGPDYRLYRVPVLEVLESGVREVVRLRTRSGRTL    64

VLTPDHPLLTPEGWKPLCDLPLGTVIAVRDVETGEVLWDPIVAVEPAGKARTFDLRVPPF   124

ANFVSEDLVVHNSAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK   344

DGYLAPIKSSIFDPVGASASPSSQPSPSVSPSPSPSPSPSASRTPTPTPTPTASPTPTLTPT   404

ATPTPTASPTPSPTAASGARCTASYQVNSDWGNGFTVTVAVTNSGSVATKTWTVSWTFGG   464

NQTITNSWNAAVTQNGQSVTARNMSYNNVIQPGQNTTFGFQASYTGSNAAPTVACAAS    522

P54583-mTth010-S237-5
                                             (SEQ ID NO: 2061)
MAGGGYWHTSGREILDANNVPVRIAGINWFGFETCNYVVHGLWSRDYRSMLDQIKSLGYN    60

TIRLPYSDDILKPGTMPNSINFYQMNQDLQGLTSLQVMDKIVAYAGQIGLRIILDRHRPD   120
```

-continued

```
CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPNRLVYCLAE     236/4

GSLVLDAATGQRVPIEKVRPGMEVFSLGPDYRLYRVPVLEVLESGVREVVRLRTRSGRTL      64

VLTPDHPLLTPIGWKPLCDLPLGTPIAVRDVETGEVLWDPIVAVEPAGKARTFDLRVPPF     124

ANFVSEDLVVHNSAHDYATSVYPQTWFSDPTFPNNMPGIWNKNWGYLFNQNIAPVWLGEF    136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTPTASPTPTLTPT     404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACAAS      522

P54583-mTth010-S237-6
                                                        (SEQ ID NO: 2062)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPNRLVYCLAE    236/4

GSLVLDAATGQRVPIEKVRPGMEVFSLGPDYRLYRVPVLEVLESGVREVVRLRTRSGRTL     64

VLTPDHPLLTPEGWKPLCDRPLGTPIAVRDVETGEVLWDPIVAVEPAGKARTFDLRVPPF    124

ANFVSEDLVVHNSAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK    344

DGYLAPIKSSIFDPVGASASPSSQPSPSVSPSPSPSPSASRTPTPTPTPTASPTPTLTPT    404

ATPTPTASPTPSPTAASGARCTASYQVNSDWGNGFTVTVAVTNSGSVATKTWTVSWTFGG    464

NQTITNSWNAAVTQNGQSVTARNMSYNNVIQPGQNTTFGFQASYTGSNAAPTVACAAS     522

P54583-mTth010-S237-19
                                                        (SEQ ID NO: 2063)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQAIAQRYKGNPTVVGFDLHNEPHDPACWGCGDPSIDWR    180

LAAERAGNAVLSVNPNLLIFVEGVQSYNGDSYWWGGNLQGAGQYPVVLNVPNRLVYCLAE   236/4

GSLVLDAATGQRVPIEKVRPGMEVFSLGPDYRLYRVPVLEVLESGVREVVRLRTRSGRTL     64

VLTPDHPLLTPEGWKPLCDLPLVTPIAVRDVETGEVLWDPIVAVEPAGKARTFDLRVPPF    124

ANFVSEDLVVHNSAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK    344

DGYLAPIKSSIFDPVGASASPSSQPSPSVSPSPSPSPSASRTPTPTPTPTASPTPTLTPT    404

ATPTPTASPTPSPTAASGARCTASYQVNSDWGNGFTVTVAVTNSGSVATKTWTVSWTFGG    464

NQTITNSWNAAVTQNGQSVTARNMSYNNVIQPGQNTTFGFQASYTGSNAAPTVACVAS     522

P54583-mTth010-S237-24
                                                        (SEQ ID NO: 2064)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD    120

CSGQSALWYTSSVSEATWISDLQALAQRYKGNPTVVGFDLHNEPHDPACWGCGDPSIDWR    180

LAAERAGNAVLSVNPNLLIFVEGVQSYNGDSYWWGGNLQGAGQYPVVLNVPNRLVYCLAE   236/4

GSLVLDAATGQRVPIEKVRPGMEVFSLGPDYRLYRVPVLEVLESGVREVVRLRTRSGRTL     64

VLTPDHPLLTPEGWKPLCDLPLGTPIAVRDVETGEVLWDPIVAVEPAGKRRTFDLRVPPF    124

ANFVSEDLVVHNSAHDYATSVYPQTWFSDPTFPNNMPGIWNKNWGYLFNQNIAPVWLGEF  136/284
```

-continued

```
GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACAAS        522

P54583-mTth010-S237-33
                                                    (SEQ ID NO: 2065)
MAGGGYWHTSGREILDANNVPVRIAGINWFGFETCNYVVHGLWSRDYRSMLDQIKSLGYN       60

TIRLPYSDDILKPGTMPNSINFYQMNDLQGLTSLQVMDKIVAYAGQIGLRIILDRHRPD      120

CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPNRLVYCLAE      236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEVAGKARTFDLRVPPF      124

ANFVSEDLVVHNSAHDYATSVYPQTWFSDPTFPNNMPGIWNKNWGYLFNQNIAPVWLGEF      136/284

GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACAAS        522

P54583-mTth010-S237-42
                                                    (SEQ ID NO: 2066)
MAGGGYWHTSGREILDANNVPVRIAGINWFGFETCNYVVHGLWSRDYRSMLDQIKSLGYN       60

TIRLPYSDDILKPGTMPNSINFYQMNDLQGLTSLQVMDKIVAYAGQIGLRIILDRHRPD      120

CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPNRAVYCLAE      236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEPAGKARTFDLRVPPF      124

ANFVSEDLVVHNSAHDYATSVYPQTWFSDPTFPNNMPGIWNKNWGYLFNQNIAPVWLGEF      136/284

GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACVAS        522

P54583-mTth010-S237-43
                                                    (SEQ ID NO: 2067)
MAGGGYWHTSGREILDANNVPVRIAGINWFGFETCNYVVHGLWSRDYRSMLDQIKSLGYN       60

TIRLPYSDDILKPGTMPNSINFYQMNDLQGLTSLQVMDKIVAYAGQIGLRIILDRHRPD      120

CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPKRLVYCLAE      236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEPAGKARTFDLRVPPF      124

ANFVSEDLVVHNSAHDYATSVYPQTWFSDPTFPNNMPGIWNKNWGYLFNQNIAPVWLGEF      136/284

GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACVAS        522
```

-continued

P54583-mTth010-S237-44
(SEQ ID NO: 2068)

| | |
|---|---|
| MAGGGYWHTSGREILDANNVPVRIAGINWFGFETCNYVVHGLWSRDYRSMLDQIKSLGYN | 60 |
| TIRLPYSDDILKPGTMPNSINFYQMNQDLQGLTSLQVMDKIVAYAGQIGLRIILDRHRPD | 120 |
| CSGQSALWYTSSVSEATWISDLQALAQRYKGNPTVVGFDLHNEPHDPACWGCGDPSIDWR | 180 |
| LAAERAGNAVLSVNPNLLIFVEGVQSYNGDSYWWGGNLQGAGQYPVVLNVPNRLVY<u>CLAE</u> | 236/4 |
| <u>GSLVLDAATGQRVPIEKVRPGMEVFSLGPDYRLYRVPVLEVLESGVREVVRLRTRSGRTL</u> | 64 |
| <u>VLTPDHPLLTPEGWKPLCDLPLGTPIAVRDVETGKVLYDPIVAVEPAGKARTFDLRVPPF</u> | 124 |
| <u>ANFVSEDLVVHN</u>SAHDYATSVYPQTWFSDPTFPNNMPGIWNKNWGYLFNQNIAPVWLGEF | 136/284 |
| GTTLQSTTDQTWLKTLVQYLRPTAQYGADSFQWTFWSWNPDSGDTGGILKDDWQTVDTVK | 344 |
| DGYLAPIKSSIFDPVGASASPSSQPSPSVSPSPSPSPSASRTPTPTPTASPTPTLTPT | 404 |
| ATPTPTASPTPSPTAASGARCTASYQVNSDWGNGFTVTVAVTNSGSVATKTWTVSWTFGG | 464 |
| NQTITNSWNAAVTQNGQSVTARNMSYNNVIQPGQNTTFGFQASYTGSNAAPTVACAAS | 522 |

P54583-mTth010-S237-45
(SEQ ID NO: 2069)

| | |
|---|---|
| MAGGGYWHTSGREILDANNVPVRIAGINWFGFETCNYVVHGLWSRDYRSMLDQIKSLGYN | 60 |
| TIRLPYSDDILKPGTMPNSINFYQMNQDLQGLTSLQVMDKIVAYAGQIGLRIILDRHRPD | 120 |
| CSGQSALWYTSSVSEATWISDLQALAQRYKGNPTVVGFDLHNEPHDPACWGCGDPSIDWR | 180 |
| LAAERAGNAVLSVNPNLLIFVEGVQSYNGDSYWWGGNLQGAGQYPVVLNVPKRLVY<u>CLAE</u> | 236/4 |
| <u>GSLVLDAATGQRVPIEKVRPGMEVFSLGPDYRLYRVPVLEVLESGVREVVRLRTRSGRTL</u> | 64 |
| <u>VLTPDHPLLTPEGWKPLCDLPLGTPIAVRDVETGEVLWDPIVAVEPAGKARTFDLRVPPF</u> | 124 |
| <u>ANFVSEDLVVHN</u>SAHDYATSVYPQTWFSDPTFPNNMPGIWNKNWGYLFNQNIAPVWLGEF | 136/284 |
| GTTLQSTTDQTWLKTLVQYLRPTAQYGADSFQWTFWSWNPDSGDTGGILKDDWQTVDTVK | 344 |
| DGYLAPIKSSIFDPVGASASPSSQPSPSVSPSPSPSPSASRTPTPTPTASPTPTLTPT | 404 |
| ATPTPTASPTPSPTAASGARCTASYQVNSDWGNGFTVTVAVTNSGSVATKTWTVSWTFGG | 464 |
| NQTITNSWNAAVTQNGQSVTARNMSYNNVIQPGQNTTFGFQASYTGSNAAPTVACVAS | 522 |

P54583-mTth010-S237-46
(SEQ ID NO: 2070)

| | |
|---|---|
| MAGGGYWHTSGREILDANNVPVRIAGINWFGFETCNYVVHGLWSRDYRSMLDQIKSLGYN | 60 |
| TIRLPYSDDILKPGTMPNSINFYQMNQDLQGLTSLQVMDKIVAYAGQIGLRIILDRHRPD | 120 |
| CSGQSALWYTSSVSEATWISDLQALAQRYKGNPTVVGFDLHNEPHDPACWGCGDPSIDWR | 180 |
| LAAERAGNAVLSVNPNLLIFVEGVQSYNGDSYWWGGNLQGAGQYPVVLNVPNRLSY<u>CLAE</u> | 236/4 |
| <u>GSLVLDAATGQRVPIEKVRPGMEVFSLGPDYRLYRVPVLEVLESGVREVVRLRTRSGRTL</u> | 64 |
| <u>VLTPDHPLLTPEGWKPLCDLPLGTPIAVRDVETGEVLWDPIVAVEPAGKARTFDLRVPPF</u> | 124 |
| <u>ANFVSEDLVVHN</u>SAHDYATSVYPQTWFSDPTFPNNMPGIWNKNWGYLFNQNIAPVWLGEF | 136/284 |
| GTTLQSTTDQTWLKTLVQYLRPTAQYGADSFQWTFWSWNPDSGDTGGILKDDWQTVDTVK | 344 |
| DGYLAPIKSSIFDPVGASASPSSQPSPSVSPSPSPSPSASRTPTPTPTASPTPTLTPT | 404 |
| ATPTPTASPTPSPTAASGARCTASYQVNSDWGNGFTVTVAVTNSGSVATKTWTVSWTFGG | 464 |
| NQTITNSWNAAVTQNGQSVTARNMSYNNVIQPGQNTTFGFQASYTGSNAAPTVACVAS | 522 |

P54583-mTth010-S237-47
(SEQ ID NO: 2071)

| | |
|---|---|
| MAGGGYWHTSGREILDANNVPVRIAGINWFGFETCNYVVHGLWSRDYRSMLDQIKSLGYN | 60 |
| TIRLPYSDDILKPGTMPNSINFYQMNQDLQGLTSLQVMDKIVAYAGQIGLRIILDRHRPD | 120 |
| CSGQSALWYTSSVSEATWISDLQALAQRYKGNPTVVGFDLHNEPHDPACWGCGDPSIDWR | 180 |
| LAAERAGNAVLSVNPNLLIFVEGVQSYNGDSYWWGGNLQGAGQYPVVLNVPNGLVY<u>CLAE</u> | 236/4 |

```
GSLVLDAATGQRVPIEKVRPGMEVFSLGPDYRLYRVPVLEVLESGVREVVRLRTRSGRTL      64

VLTPDHPLLTPEGWKPLCDLPLGTPIAVRDVETGEVLWDPIVAVEPAGKARTFDLRVPPF     124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTPTASPTPTLTPT     404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS      522

P54583-mTth010-S237-48
                                                       (SEQ ID NO: 2072)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPNRLVYCLAE     236/4

GSLVLDAATGQRVPIEKVRPGMEVFSLGPDYRLYRVPVLEVLESGVREVVRLRTRSGRTL     64

VLTPDHPLLTPEGWKPLCDLPLGTPIAVRDVETGEVRWDPIVAVEPAGKARTFDLRVPPF    124

ANFVSEDLVVHNSAHDYATSVYPQTWFSDPTFPNNMPGIWNKNWGYLFNQNIAPVWLGEF    136/284

GTTLQSTTDQTWLKTLVQYLRPTAQYGADSFQWTFWSWNPDSGDTGGILKDDWQTVDTVK    344

DGYLAPIKSSIFDPVGASASPSSQPSPSVSPSPSPSPSASRTPTPTPTPTASPTPTLTPT    404

ATPTPTASPTPSPTAASGARCTASYQVNSDWGNGFTVTVAVTNSGSVATKTWTVSWTFGG    464

NQTITNSWNAAVTQNGQSVTARNMSYNNVIQPGQNTTFGFQASYTGSNAAPTVACVAS     522

P54583-mTth010-S237-49
                                                       (SEQ ID NO: 2073)
MAGGGYWHTSGREILDANNVPVRIAGINWFGFETCNYVVHGLWSRDYRSMLDQIKSLGYN     60

TIRLPYSDDILKPGTMPNSINFYQMNQDLQGLTSLQVMDKIVAYAGQIGLRIILDRHRPD    120

CSGQSALWYTSSVSEATWISDLQALAQRYKGNPTVVGFDLHNEPHDPACWGCGDPSIDWR    180

LAAERAGNAVLSVNPNLLIFVEGVQSYNGDSYWWGGNLQGAGQYPVVLNVPKRLVYCLAE    236/4

GSLVLDAATGQRVPIEKVRPGMEVFSLGPDYRLYRVPVLEVLESGVREVVRLRTRSGRTL     64

VLTPDHPLLTPEGWKPLCDLPLGTPIAVRDVETGEVLWDPIVAVEPAGKARTFDLRVPPF    124

ANFVSEDLVVHNSAHDYATSVYPQTWFSDPTFPNNMPGIWNKNWGYLFNQNIAPVWLGEF    136/284

GTTLQSTTDQTWLKTLVQYLRPTAQYGADSFQWTFWSWNPDSGDTGGILKDDWQTVDTVK    344

DGYLAPIKSSIFDPVGASASPSSQPSPSVSPSPSPSPSASRTPTPTPTPTASPTPTLTPT    404

ATPTPTASPTPSPTAASGARCTASYQVNSDWGNGFTVTVAVTNSGSVATKTWTVSWTFGG    464

NQTITNSWNAAVTQNGQSVTARNMSYNNVIQPGQNTTFGFQASYTGSNAAPTVACVAS     522

P54583-mTth010-S237-50
                                                       (SEQ ID NO: 2074)
MAGGGYWHTSGREILDANNVPVRIAGINWFGFETCNYVVHGLWSRDYRSMLDQIKSLGYN     60

TIRLPYSDDILKPGTMPNSINFYQMNQDLQGLTSLQVMDKIVAYAGQIGLRIILDRHRPD    120

CSGQSALWYTSSVSEATWISDLQALAQRYKGNPTVVGFDLHNEPHDPACWGCGDPSIDWR    180

LAAERAGNAVLSVNPNLLIFVEGVQSYNGDSYWWGGNLQGAGQYPVVLNVPCRLVYCLAE    236/4

GSLVLDAATGQRVPIEKVRPGMEVFSLGPDYRLYRVPVLEVLESGVREVVRLRTRSGRTL     64

VLTPDHPLLTPEGWKPLCDLPLGTPIAVRDVETGEVLWDPIVAVEPAGKARTFDLRVPPF    124

ANFVSEDLVVHNSAHDYATSVYPQTWFSDPTFPNNMPGIWNKNWGYLFNQNIAPVWLGEF    136/284

GTTLQSTTDQTWLKTLVQYLRPTAQYGADSFQWTFWSWNPDSGDTGGILKDDWQTVDTVK    344

DGYLAPIKSSIFDPVGASASPSSQPSPSVSPSPSPSPSASRTPTPTPTPTASPTPTLTPT    404
```

```
ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACVAS       522

P54583-mTth010-S237-51
                                                    (SEQ ID NO: 2075)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPLRLVY<u>CLAE</u>    236/4

<u>GSLVLDAATGQRVPIEKVRPGMEVFSLGPDYRLYRVPVLEVLESGVREVVRLRTRSGRTL</u>     64

<u>VLTPDHPLLTPEGWKPLCDLPLGTPIAVRDVETGEVLWDPIVAVEPAGKARTFDLRVPPF</u>    124

<u>ANFVSEDLVVHN</u>SAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522

P54583-mTth010-S237-52
                                                    (SEQ ID NO: 2076)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPNRGVY<u>CLAE</u>    236/4

<u>GSLVLDAATGQRVPIEKVRPGMEVFSLGPDYRLYRVPVLEVLESGVREVVRLRTRSGRTL</u>     64

<u>VLTPDHPLLTPEGWKPLCDLPLGTPIAVRDVETGEVLWDPIVAVEPAGKARTFDLRVPPF</u>    124

<u>ANFVSEDLVVHN</u>SAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522

P54583-mTth010-S237-53
                                                    (SEQ ID NO: 2077)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPSRLVY<u>CLAE</u>    236/4

<u>GSLVLDAATGQRVPIEKVRPGMEVFSLGPDYRLYRVPVLEVLESGVREVVRLRTRSGRTL</u>     64

<u>VLTPDHPLLTPEGWKPLCDLPLGTPIAVRDVETGEVLWDPIVAVEPAGKARTFDLRVPPF</u>    124

<u>ANFVSEDLVVHN</u>SAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522

P54583-mTth010-S237-54
                                                    (SEQ ID NO: 2078)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120
```

-continued

```
CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPWRLVYCLAE     236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEPAGKARTFDLRVPPF      124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACVAS       522
```

P54583-mTth010-S237-55

(SEQ ID NO: 2079)
```
MAGGGYWHTSGREILDANNVPVRIAGINWFGFETCNYVVHGLWSRDYRSMLDQIKSLGYN       60

TIRLPYSDDILKPGTMPNSINFYQMNQDLQGLTSLQVMDKIVAYAGQIGLRIILDRHRPD      120

CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPNLLVYCLAE     236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEPAGKARTFDLRVPPF      124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACVAS       522
```

P54583-mTth010-S237-56

(SEQ ID NO: 2080)
```
MAGGGYWHTSGREILDANNVPVRIAGINWFGFETCNYVVHGLWSRDYRSMLDQIKSLGYN       60

TIRLPYSDDILKPGTMPNSINFYQMNQDLQGLTSLQVMDKIVAYAGQIGLRIILDRHRPD      120

CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPVRLVYCLAE     236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEPAGKARTFDLRVPPF      124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK      344

DGYLAPIKSSIFDPVGASASPSSQPSPSVSPSPSPSPSASRTPTPTPTPTASPTPTLTPT      404

ATPTPTASPTPSPTAASGARCTASYQVNSDWGNGFTVTVAVTNSGSVATKTWTVSWTFGG      464

NQTITNSWNAAVTQNGQSVTARNMSYNNVIQPGQNTTFGFQASYTGSNAAPTVACVAS       522
```

P54583-mTth010-S237-57

(SEQ ID NO: 2081)
```
MAGGGYWHTSGREILDANNVPVRIAGINWFGFETCNYVVHGLWSRDYRSMLDQIKSLGYN       60

TIRLPYSDDILKPGTMPNSINFYQMNQDLQGLTSLQVMDKIVAYAGQIGLRIILDRHRPD      120

CSGQSALWYTSSVSEATWISDLQALAQRYKGNPTVVGFDLHNEPHDPACWGCGDPSIDWR      180

LAAERAGNAVLSVNPNLLIFVEGVQSYNGDSYWWGGNLQGAGQYPVVLNVPNSLVYCLAE     236/4

GSLVLDAATGQRVPIEKVRPGMEVFSLGPDYRLYRVPVLEVLESGVREVVRLRTRSGRTL       64

VLTPDHPLLTPEGWKPLCDLPLGTPIAVRDVETGEVLWDPIVAVEPAGKARTFDLRVPPF      124

ANFVSEDLVVHNSAHDYATSVYPQTWFSDPTFPNNMPGIWNKNWGYLFNQNIAPVWLGEF     136/284
```

```
GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522

P54583-mTth010-S237-58
                                              (SEQ ID NO: 2082)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPMRLVYCLAE     236/4

GSLVLDAATGQRVPIEKVRPGMEVFSLGPDYRLYRVPVLEVLESGVREVVRLRTRSGRTL      64

VLTPDHPLLTPEGWKPLCDLPLGTPIAVRDVETGEVLWDPIVAVEPAGKARTFDLRVPPF     124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522

P54583-mTth010-S237-59
                                              (SEQ ID NO: 2083)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPARLVYCLAE     236/4

GSLVLDAATGQRVPIEKVRPGMEVFSLGPDYRLYRVPVLEVLESGVREVVRLRTRSGRTL      64

VLTPDHPLLTPEGWKPLCDLPLGTPIAVRDVETGEVLWDPIVAVEPAGKARTFDLRVPPF     124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522

P54583-mTth010-S237-60
                                              (SEQ ID NO: 2084)
MAGGGYWHTSGREILDANNVPVRIAGINWFGFETCNYVVHGLWSRDYRSMLDQIKSLGYN      60

TIRLPYSDDILKPGTMPNSINFYQMNQDLQGLTSLQVMDKIVAYAGQIGLRIILDRHRPD     120

CSGQSALWYTSSVSEATWISDLQALAQRYKGNPTVVGFDLHNEPHDPACWGCGDPSIDWR     180

LAAERAGNAVLSVNPNLLIFVEGVQSYNGDSYWWGGNLQGAGQYPVVLNVPVRLVYCLAE     236/4

GSLVLDAATGQRVPIEKVRPGMEVFSLGPDYRLYRVPVLEVLESGVREVVRLRTRSGRTL      64

VLTPDHPLLTPEGWKPLCDLPLGTPIAVRDVETGEVLWDPIVAVEPAGKARTFDLRVPPF     124

ANFVSEDLVVHNSAHDYATSVYPQTWFSDPTFPNNMPGIWNKNWGYLFNQNIAPVWLGEF     136/284

GTTLQSTTDQTWLKTLVQYLRPTAQYGADSFQWTFWSWNPDSGDTGGILKDDWQTVDTVK     344

DGYLAPIKSSIFDPVGASASPSSQPSPSVSPSPSPSPSASRTPTPTPTASPTPTLTPT       404

ATPTPTASPTPSPTAASGARCTASYQVNSDWGNGFTVTVAVTNSGSVATKTWTVSWTFGG     464

NQTITNSWNAAVTQNGQSVTARNMSYNNVIQPGQNTTFGFQASYTGSNAAPTVACVAS       522
```

-continued

P54583-mTth010-S237-61

(SEQ ID NO: 2085)

```
MAGGGYWHTSGREILDANNVPVRIAGINWFGFETCNYVVHGLWSRDYRSMLDQIKSLGYN    60
TIRLPYSDDILKPGTMPNSINFYQMNQDLQGLTSLQVMDKIVAYAGQIGLRIILDRHRPD   120
CSGQSALWYTSSVSEATWISDLQALAQRYKGNPTVVGFDLHNEPHDPACWGCGDPSIDWR   180
LAAERAGNAVLSVNPNLLIFVEGVQSYNGDSYWWGGNLQGAGQYPVVLNVPNRLVYCLAE   236/4
GSLVLDAATGQRVPIEKVRPGMEVFSLGPDYRLYRVPVLEVLESGVREVVRLRTRSGRTL    64
VLTPDHPLLTPEGWKPLCDLPLGTPIAVRDVETGEVMWDPIVAVEPAGKARTFDLRVPPF   124
ANFVSEDLVVHNSAHDYATSVYPQTWFSDPTFPNNMPGIWNKNWGYLFNQNIAPVWLGEF   136/284
GTTLQSTTDQTWLKTLVQYLRPTAQYGADSFQWTFWSWNPDSGDTGGILKDDWQTVDTVK   344
DGYLAPIKSSIFDPVGASASPSSQPSPSVSPSPSPSPSASRTPTPTPTASPTPTLTPT    404
ATPTPTASPTPSPTAASGARCTASYQVNSDWGNGFTVTVAVTNSGSVATKTWTVSWTFGG   464
NQTITNSWNAAVTQNGQSVTARNMSYNNVIQPGQNTTFGFQASYTGSNAAPTVACAAS    522
```

P54583-mTth010-S237-62

(SEQ ID NO: 2086)

```
MAGGGYWHTSGREILDANNVPVRIAGINWFGFETCNYVVHGLWSRDYRSMLDQIKSLGYN    60
TIRLPYSDDILKPGTMPNSINFYQMNQDLQGLTSLQVMDKIVAYAGQIGLRIILDRHRPD   120
CSGQSALWYTSSVSEATWISDLQALAQRYKGNPTVVGFDLHNEPHDPACWGCGDPSIDWR   180
LAAERAGNAVLSVNPNLLIFVEGVQSYNGDSYWWGGNLQGAGQYPVVLNVPSRLVYCLAE   236/4
GSLVLDAATGQRVPIEKVRPGMEVFSLGPDYRLYRVPVLEVLESGVREVVRLRTRSGRTL    64
VLTPDHPLLTPEGWKPLCDLPLGTPIAVRDVETGEVLWDPIVAVEPAGKARTFDLRVPPF   124
ANFVSEDLVVHNSAHDYATSVYPQTWFSDPTFPNNMPGIWNKNWGYLFNQNIAPVWLGEF   136/284
GTTLQSTTDQTWLKTLVQYLRPTAQYGADSFQWTFWSWNPDSGDTGGILKDDWQTVDTVK   344
DGYLAPIKSSIFDPVGASASPSSQPSPSVSPSPSPSPSASRTPTPTPTASPTPTLTPT    404
ATPTPTASPTPSPTAASGARCTASYQVNSDWGNGFTVTVAVTNSGSVATKTWTVSWTFGG   464
NQTITNSWNAAVTQNGQSVTARNMSYNNVIQPGQNTTFGFQASYTGSNAAPTVACVAS    522
```

P54583-mTth010-S237-63

(SEQ ID NO: 2087)

```
MAGGGYWHTSGREILDANNVPVRIAGINWFGFETCNYVVHGLWSRDYRSMLDQIKSLGYN    60
TIRLPYSDDILKPGTMPNSINFYQMNQDLQGLTSLQVMDKIVAYAGQIGLRIILDRHRPD   120
CSGQSALWYTSSVSEATWISDLQALAQRYKGNPTVVGFDLHNEPHDPACWGCGDPSIDWR   180
LAAERAGNAVLSVNPNLLIFVEGVQSYNGDSYWWGGNLQGAGQYPVVLNVPNRLGYCLAE   236/4
GSLVLDAATGQRVPIEKVRPGMEVFSLGPDYRLYRVPVLEVLESGVREVVRLRTRSGRTL    64
VLTPDHPLLTPEGWKPLCDLPLGTPIAVRDVETGEVLWDPIVAVEPAGKARTFDLRVPPF   124
ANFVSEDLVVHNSAHDYATSVYPQTWFSDPTFPNNMPGIWNKNWGYLFNQNIAPVWLGEF   136/284
GTTLQSTTDQTWLKTLVQYLRPTAQYGADSFQWTFWSWNPDSGDTGGILKDDWQTVDTVK   344
DGYLAPIKSSIFDPVGASASPSSQPSPSVSPSPSPSPSASRTPTPTPTASPTPTLTPT    404
ATPTPTASPTPSPTAASGARCTASYQVNSDWGNGFTVTVAVTNSGSVATKTWTVSWTFGG   464
NQTITNSWNAAVTQNGQSVTARNMSYNNVIQPGQNTTFGFQASYTGSNAAPTVACVAS    522
```

P54583-mTth010-S237-64

(SEQ ID NO: 2088)

```
MAGGGYWHTSGREILDANNVPVRIAGINWFGFETCNYVVHGLWSRDYRSMLDQIKSLGYN    60
TIRLPYSDDILKPGTMPNSINFYQMNQDLQGLTSLQVMDKIVAYAGQIGLRIILDRHRPD   120
CSGQSALWYTSSVSEATWISDLQALAQRYKGNPTVVGFDLHNEPHDPACWGCGDPSIDWR   180
LAAERAGNAVLSVNPNLLIFVEGVQSYNGDSYWWGGNLQGAGQYPVVLNVPNRLVYCLAE   236/4
```

```
GSLVLDAATGQRVPIEKVRPGMEVFSLGPDYRLYRVPVLEVLESGVREVVRLRTRSGRTL    64

VLTPDHPLLTPEGWKPLCDLPLGTPIAVRDVETGEVLWVPIAVEPAGKARTFDLRVPPF    124

ANFVSEDLVVHNSAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK   344

DGYLAPIKSSIFDPVGASASPSSQPSPSVSPSPSPSPSASRTPTPTPTPTASPTPTLTPT   404

ATPTPTASPTPSPTAASGARCTASYQVNSDWGNGFTVTVAVTNSGSVATKTWTVSWTFGG   464

NQTITNSWNAAVTQNGQSVTARNMSYNNVIQPGQNTTFGFQASYTGSNAAPTVACAAS    522

P54583-mTth010-S237-66
                                                  (SEQ ID NO: 2089)
MAGGGYWHTSGREILDANNVPVRIAGINWFGFETCNYVVHGLWSRDYRSMLDQIKSLGYN    60

TIRLPYSDDILKPGTMPNSINFYQMNQDLQGLTSLQVMDKIVAYAGQIGLRIILDRHRPD   120

CSGQSALWYTSSVSEATWISDLQAIAQRYKGNPTVVGFDLHNEPHDPACWGCGDPSIDWR   180

LAAERAGNAVLSVNPNLLIFVEGVQSYNGDSYWWGGNLQGAGQYPVVLNVPNRLVYCLAE   236/4

GSLVLDAATGQRVPIEKVRPGMEVFSLGPDYRLYRVPVLEVLESGVREVVRLRTRSGRTL    64

VLTPDHPLLTPEGWKPLCDLPLVTPIAVRDVETGEVLWDPIAVEPAGKARTFDLRVPPF    124

ANFVSEDLVVHNSAHDYATSVYPQTWFSDPTFPNNMPGIWNKNWGYLFNQNIAPVWLGEF   136/284

GTTLQSTTDQTWLKTLVQYLRPTAQYGADSFQWTFWSWNPDSGDTGGILKDDWQTVDTVK   344

DGYLAPIKSSIFDPVGASASPSSQPSPSVSPSPSPSPSASRTPTPTPTPTASPTPTLTPT   404

ATPTPTASPTPSPTAASGARCTASYQVNSDWGNGFTVTVAVTNSGSVATKTWTVSWTFGG   464

NQTITNSWNAAVTQNGQSVTARNMSYNNVIQPGQNTTFGFQASYTGSNAAPTVACVAS    522
```

Example 12—Termite Endoglucanases

An endoglucanase from *Nasutitermes takasagoensis* was modified with an intein such that the intein compromises the activity of the endoglucanase, and excision of the intein (either spontaneously or in response to a stimulus such as temperature shift) reconstitutes activity of the endoglucanase. The intein-modified endoglucanase may be used in applications that require the conditional hydrolysis of cellulosic materials and/or other polysaccharides that can be recognized as substrates by the endoglucanase. The termite-derived endoglucanase may have advantageous pH tolerance, expression, and/or higher specific activity relative to other endoglucanases. For example, a pH inducible intein could be inserted in endoglucanase.

Termites naturally metabolize a variety of lignocellulosic materials by virtue of their unique anatomy, physiology, and symbiotic microflora. As termites consume lignocellulosic materials, they mix the particulate matter with a variety of enzymes. Passing through the termite gut, the materials encounter pH changes that range from mildly acidic to strongly basic. Particles are then taken up by symbionts that populate the termite gut and are further metabolized. Exchanges of organic metabolites between the symbionts and the termite provide a means by which the termites derive indirect nutritional benefit from the ingested materials.

Not all of the digestive enzymes responsible for the breakdown of lignocellulosic materials in termites are microbial in origin. Some of the most active enzymes in the termite system are actually expressed and secreted by the termites themselves and subsequently taken up by the symbionts along with the particulate materials. In some termite species, such as *Reticulitermes speratus* or *Mastotermes darwiniensis*, endoglucanases are secreted from the salivary glands and are mixed with the woody material during mastication, after which they pass into the gut and are then taken up by the symbionts. In other species, such as *Nasutitermes takasagoensis*, the enzymes are secreted directly in the midgut.

Figure 27:
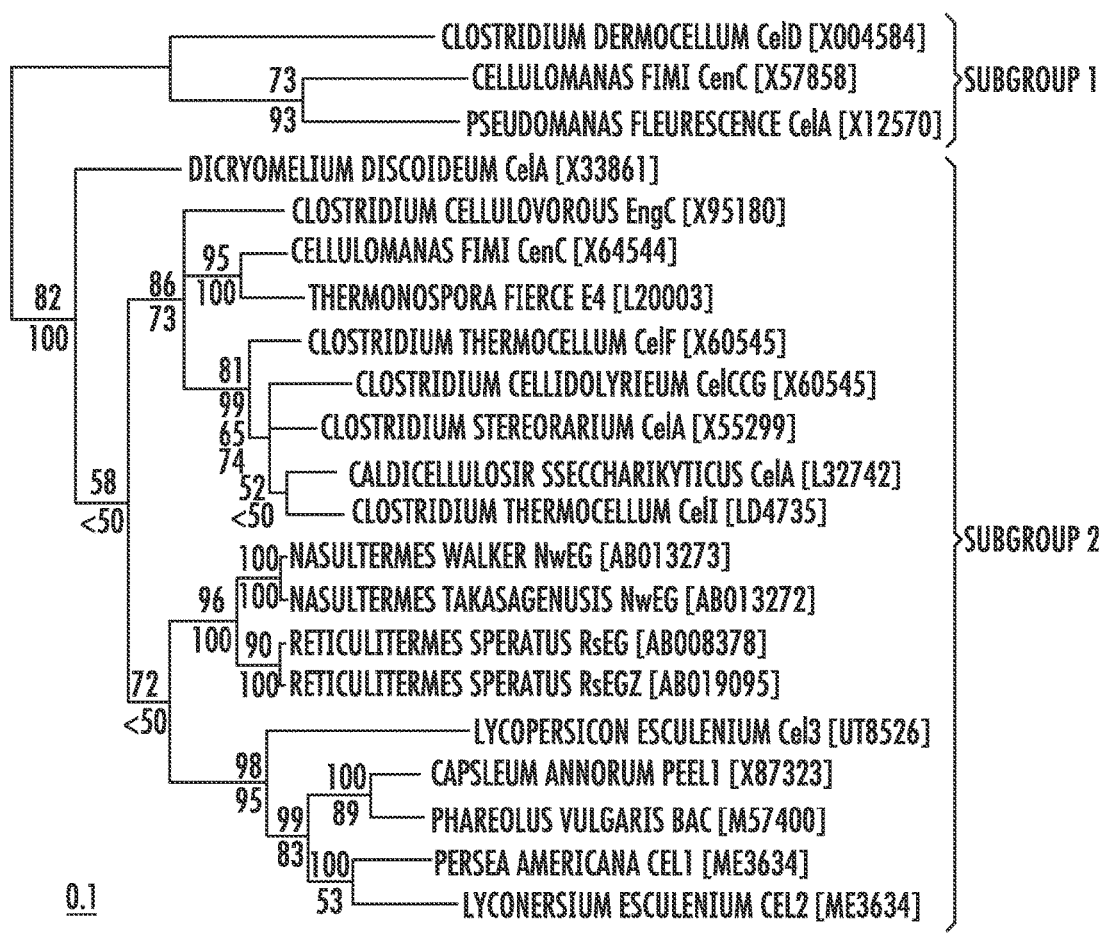
FIG. 27 illustrates a phylogenetic tree of endoglucanases.

FIG. 27 shows the phylogeny of termite endoglucanases. Amino acid sequence comparisons of the catalytic domains from a variety of glycosyl hydrolase 9 (GH9) endoglucanases reveals considerable similarity among termite (*Nasutitermes, Reticulitermes*), microbial, and plant-derived enzymes. As shown, endoglucanases (EC 3.1.2.4) expressed by primitive and more apical termites share significant homology not only with each other, but also with bacterial and plant-derived enzyme. Unlike many members of the GH9 family of enzymes, termite endoglucanases typically lack carbohydrate binding domains, consisting solely of the catalytic domains. NtEG, an endoglucanase from *Nasutitermes takasagoensis*, can be expressed in *E. coli* as a functional enzyme. Differential cellulolytic activity of the native-form and C-terminal tagged-form of a cellulase derived from *Coptotermes formosanus* and expressed in *E. coli* has enabled the in vitro evolution of enzyme derivatives with enhanced properties such as thermostability. Random exchanges of non-conserved amino acid residues among four parental termite cellulases by family shuffling has also improved thermostability. Any of these cellulases can be modified with an intein, as outlined herein.

The NtEG endoglucanase has been shown to be structurally stable under very acidic conditions. This may reflect the fact that, as mentioned previously, termite-derived endoglucanases are exposed to a wide pH range in the gut. The major endoglucanase from *Nasutitermes takasagoensis* (NtEG) has been crystallized and it undergoes only very subtle changes in structure across pH ranges from 6.5 to 2.5. Termite-derived intein modified endoglucanases may be provided in conditions involving exposure to strong pH changes.

Example 13—Expression and Characterization of Termite Endoglucanases

A codon-optimized version of NtEG (077044, SEQ ID NO: 2017) was prepared. The DNA sequence of NtEG as optimized for expression in plants is shown below. Included in this sequence is a region (underlined in the sequence below) that encodes an N-terminal polypeptide of about 16 amino acids that likely functions as a secretion signal when the protein is expressed in termite cells.

Codon Optimized NtEG (SEQ ID NO: 2017)
ATGAGGGTGTTCCTTTGCCTGCTCTCGGCGCTAGCTTTGTGCCAGGCGGC

TTACGACTACAAGCAGGTGTTGCGGGACTCGCTACTATTCTATGAGGCCC

AGAGATCCGGCCGGCTCCCAGCCGACCAGAAGGTCACGTGGAGGAAGGAT

AGCGCGCTGAATGACCAGGGTGACCAGGGACAAGACTTGACCGGCGGCTA

CTTTGACGCTGGGGACTTCGTCAAGTTCGGGTTCCCCATGGCTTATACCG

CAACCGTGCTGGCATGGGGCCTCATAGATTTTGAGGCCGGCTACAGCAGT

GCCGGGGCCTTGGATGATGGACGGAAGGCTGTCAAATGGGCCACCGACTA

TTTCATAAAGGCCCACACAAGTCAAAATGAGTTCTATGGTCAGGTCGGCC

AGGGTGACGCCGATCACGCTTTCTGGGGAAGACCAGAGGATATGACGATG

GCGCGCCCGGCGTACAAGATAGACACCTCAAGGCCTGGCTCTGATCTGGC

AGGCGAGACAGCGGCTGCTCTTGCCGCTGCTTCAATCGTGTTCCGGAACG

TCGATGGCACTTACTCAAATAACCTGTTAACACACGCTCGCCAGCTATTC

GACTTCGCGAACAACTACCGGGGAAAGTATAGTGACTCTATTACTGACGC

AAGAAATTTCTACGCAAGCGCAGACTACAGAGACGAGTTGGTTTGGGCTG

CTGCGTGGTTATACAGAGCGACCAACGACAACACCTACCTCAACACTGCT

GAGTCACTGTACGATGAGTTTGGGCTACAGAACTGGGGGGGGGGCCTGAA

CTGGGATAGCAAGGTGTCTGGCGTGCAGGTGTTGTTGGCCAAGCTTACCA

ATAAGCAGGCCTACAAGGACACGGTGCAGTCTTACGTCAATTACCTAATT

AATAACCAGCAGAAGACTCCCAAGGGCCTCCTCTACATCGACATGTGGG

CACCCTTCGCCACGCTGCCAACGCCGCATTCATCATGCTCGAAGCCGCCG

AGCTGGGCTTGTCCGCCTCCTCTTATAGACAGTTCGCGCAAACGCAAATC

GACTACGCCCTGGGCGATGGTGGCCGCTCCTTTGTGTGCGGGTTCGGGAG

TAATCCTCCTACGAGACCGCACCACAGATCCTCGTCGTGCCCGCCAGCTC

CCGCTACTTGCGACTGGAATACATTCAACTCACCTGACCCAAACTACCAC

GTCCTCTCTGGGGCCCTAGTGGGCGGACCTGATCAGAATGACAACTACGT

CGATGACCGTTCAGACTATGTTCACAACGAAGTCGCCACTGATTACAACG

CGGGTTTCCAGTCCGCGTTAGCTGCTTTGGTGGCCCTTGGTTAC

Figure 28:
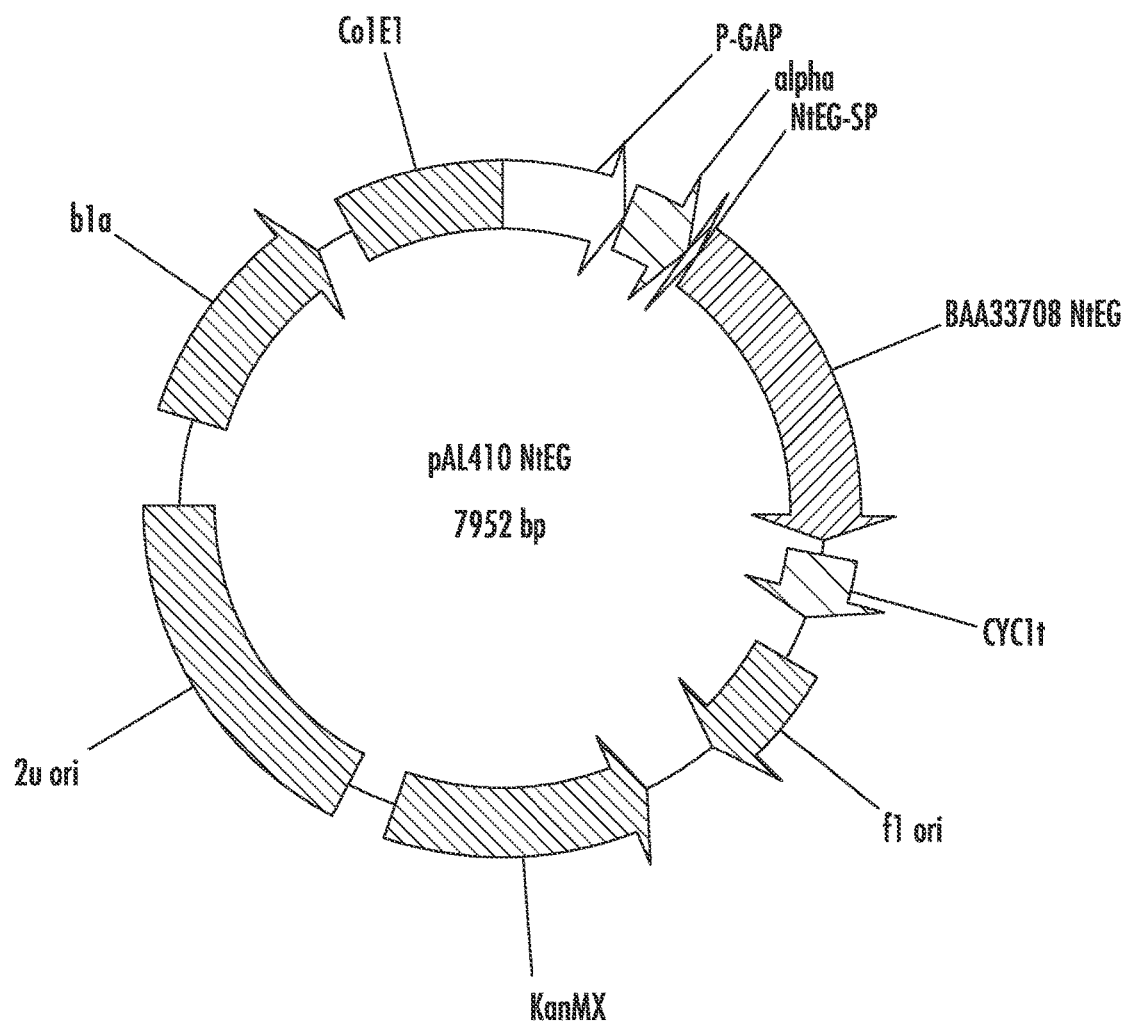
FIG. 28 illustrates a plasmid vector for expression and secreting intein modified proteins; e.g., expression an sectreting of an endoglucanase derived from termite in yeast.

A DNA fragment carrying this sequence was ligated into the *Saccharomyces cerevisiae* expression vector pAL410. The resulting construct, pAL410 NtET is illustrated in FIG. 28. In FIG. 28, P-GAP is the nominally constitutive yeast GAP promoter; alpha is the secretion signal from yeast alpha mating factor, which is translated as an N-terminal fusion to the termite-derived endoglucanase; NtEG-SP is the putative 16 amino acid signal sequence that may drive secretion of NtEG from termite cells; BAA33708 NtEG is the remainder of the coding sequence for the termite endoglucanase; CYCt is a transcriptional terminator and polyadenylation signal derived from the yeast CYC1 gene; f1 ori is the sequence for generating single-stranded plasmid derivatives; KanMX is a gene conferring resistance to G418 in yeast; 2u ori is the 2 micron origin, enabling plasmid replication in yeast cells; bla is a gene conferring ampicillin resistance in bacterial cells; and ColE1 is a region that enables replication of the plasmid in *E. coli*.

It is possible that the two signal peptides, one derived from yeast and the second native to NtEG, might conflict during expression from the pAL410. To determine whether expression of NtEG might be enhanced by removing the native signal peptide, a derivative of the NtEG expression vector was prepared that differed from the original vector only in that it lacked the 48 base pairs from the beginning of the NtEG open reading frame. These 48 base pairs encode native signal peptide. This vector (pAL410 NtEGm) was introduced into yeast cells.

Figure 29:
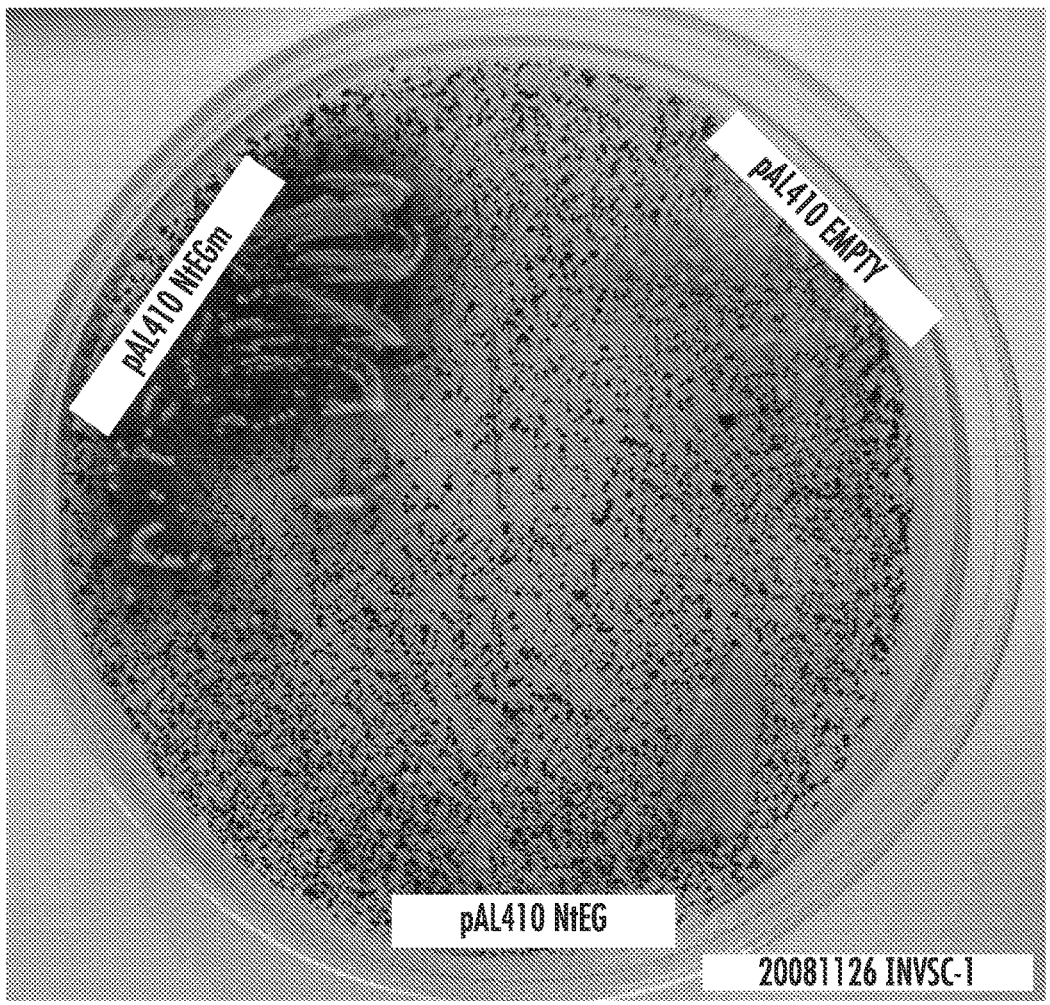
FIG. 29 illustrates yeast expressing an empty expression vector, an expression vector encoding NtEG, and an expression vector encoding a mutant NtEG lacking the native signal peptide.

Yeast cells carrying one of pAL410, pAL410 NtEG, or pAL410 NtEGm were streaked onto plates of YPD agar containing 100 mg/L G418 onto which an overlay of 1.5% agarose and 0.2% AZCL-HE-cellulose (Megazyme International Ireland Ltd) had been applied. As shown in FIG. 29, endoglucanase activity could be detected most readily in the vicinity of colonies that carried pAL410 NtEGm, indicating both that the enzyme was active and that it was being secreted from growing cells.

Figure 30:
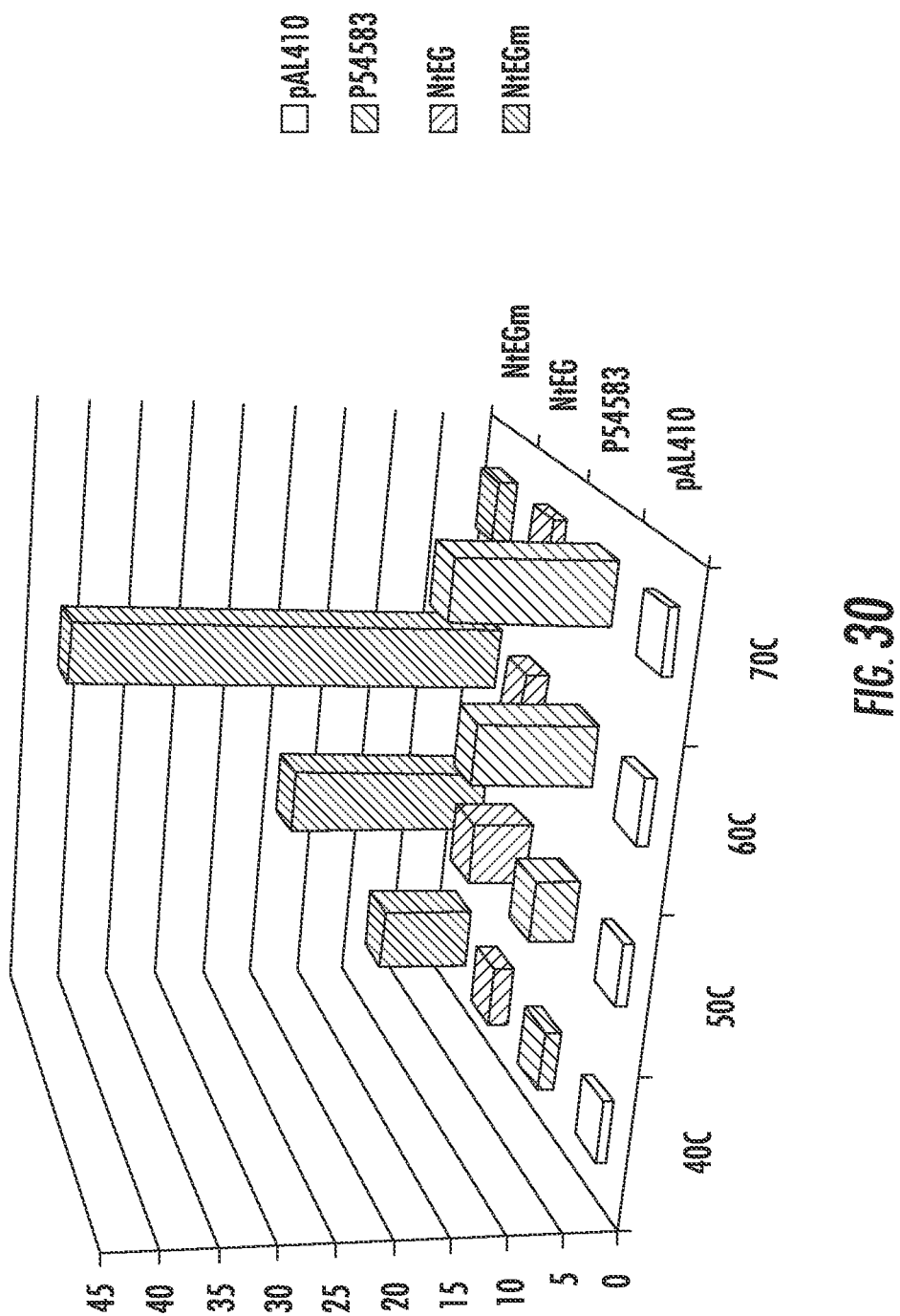
FIG. 30 illustrates endoglucanase activity of NtEG and a mutant NtEG lacking the native signal peptide over a range of temperatures.

Yeast cells carrying pAL410 NtEG, pAL410 NtEGm, or pAL410-P54583 (Ace 1 endoglucanase, see Example 7) plasmids, as well as a strain that carried the empty pAL410 vector as a control, were then grown in rich media, and the culture supernatants were assayed for endoglucanase activity via the Cellazyme C assay (Megazyme International Ireland Ltd), which measures release of dye (absorbance at 590 nm) from AZCL-HE-cellulose. As shown in FIG. 30, the mature form of the termite endoglucanase (NtEGm) clearly gives higher activity than does the full-length form, which retains the native signal sequence. NtEGm also shows higher activity than P54583. While both NtEGm and P54583 increase in activity as the temperature increases, NtEGm lost activity when incubated at 70° C., while P54583 activity continued to increase. These assays revealed that expression of NtEGm produced more detectable endoglucanase activity than did P54583.

Figure 31:
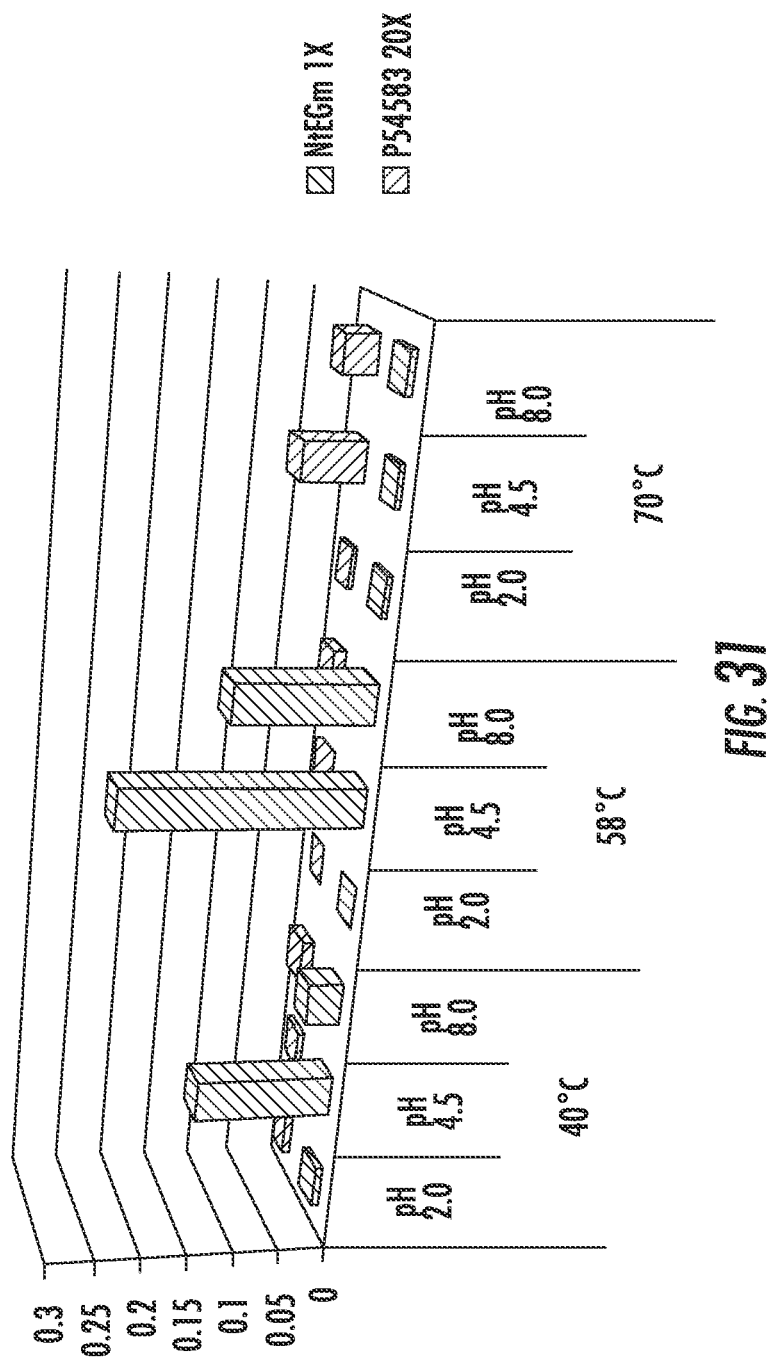
FIG. 31 illustrates endoglucanase activity of a mutant NtEG lacking the native signal peptide and P54583 a over a range of pH.

As a preliminary measure of the pH tolerance of the expressed enzymes, supernatants were collected from cultures expressing either NtEGm or P54583. Because of its lower overall activity, the supernatant from the P54583 culture was concentrated 20-fold via filtration through 10,000 molecular weight cut-off Millicon filters (Millipore, Bedford Mass.) prior to assaying. Cellazyme C assays were then carried out in buffers of different pH and at different temperatures. As shown in FIG. 31, NtEGm showed higher activity at pH 4.5 and 8.0 (as measured by absorbance at 590 nm of the released dye) than did P54583. This trend occurred when the cultures were incubated at 40° C. or at 58° C. As shown previously, though, P54583 activity outperformed that of NtEGm at 70° C. in both of the higher pH conditions.

The pH effects on enzyme stability versus pH effects on enzyme activity (catalysis) were analyzed as follows. P54583 and NtEGm were prepared from culture supernatants as above. The cultures were then exposed to buffers of different pH for 1 hour. After this treatment, buffers were exchanged with assay buffer (pH4.5) via filtration through Ultracel YM-30 regenerated cellulose filters (Millipore). Results from these assays suggest that NtEGm withstands pretreatments at pH values as high as 10.5, but is less hardy at pretreatments at pH 2 or pH 3 (data not shown).

Figure 32:
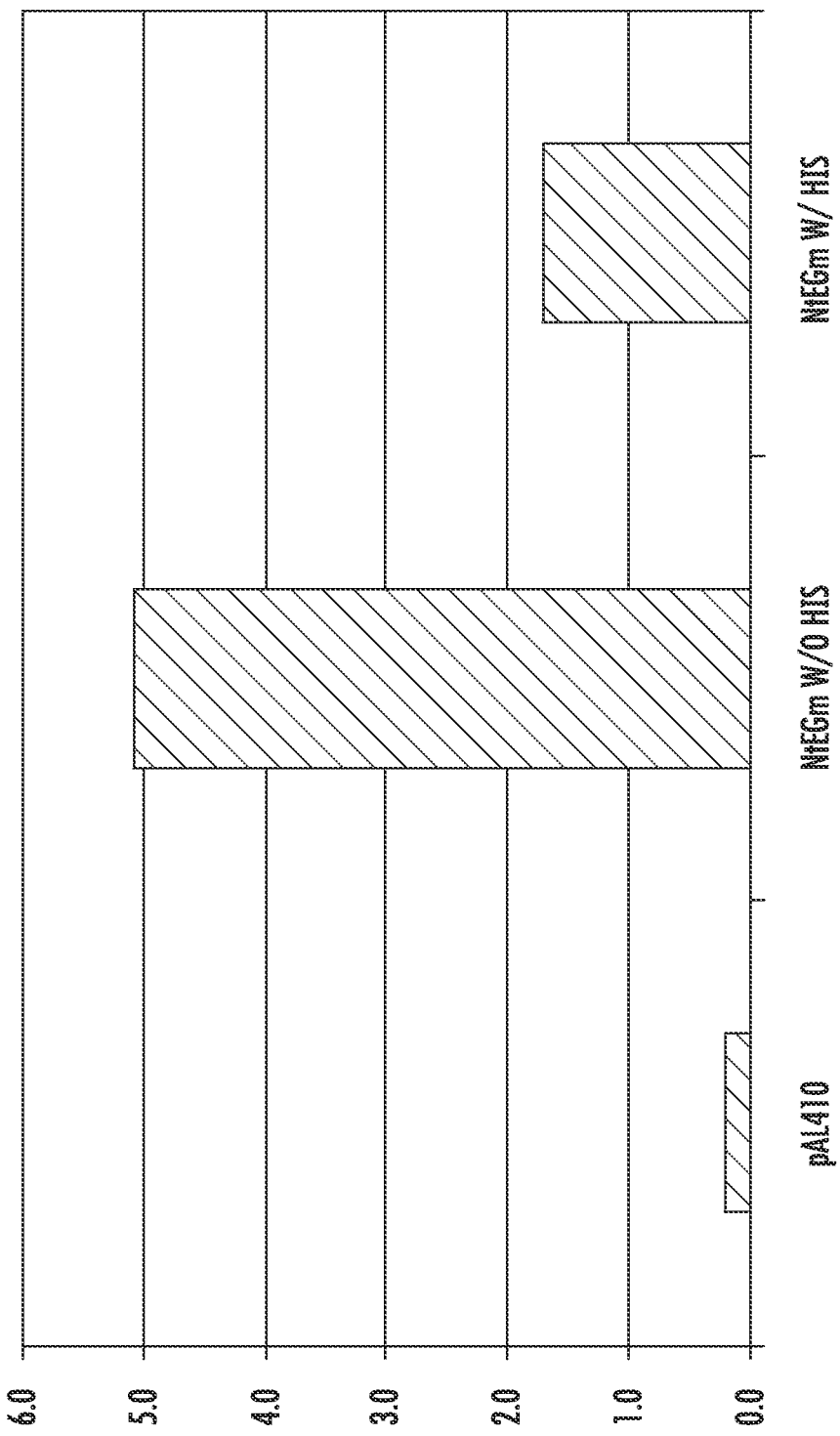
FIG. 32 illustrates endoglucanase activity of a mutant NtEG lacking the native signal peptide and with or without a His tag.

To determine whether a His tag could be added to NtEGm and whether it had any impact on activity, a version of pAL410 NtEGm was created in which 6 histidine codons were introduced immediately before the stop codon of the NtEGm coding sequence. This plasmid, pAL410 NtEGm-His, was introduced into yeast cells. Supernatants were then collected from cultures of yeast cells carrying either pAL410, pAL410NtEGm, or pAL410 NtEGmHis and assayed for endoglucanase activity as before. From these experiments (FIG. 32), it appears that the introduction of a His-tag compromises endoglucanase activity.

Example 14—Intein Modification of Termite Endoglucanases

Figure 33:
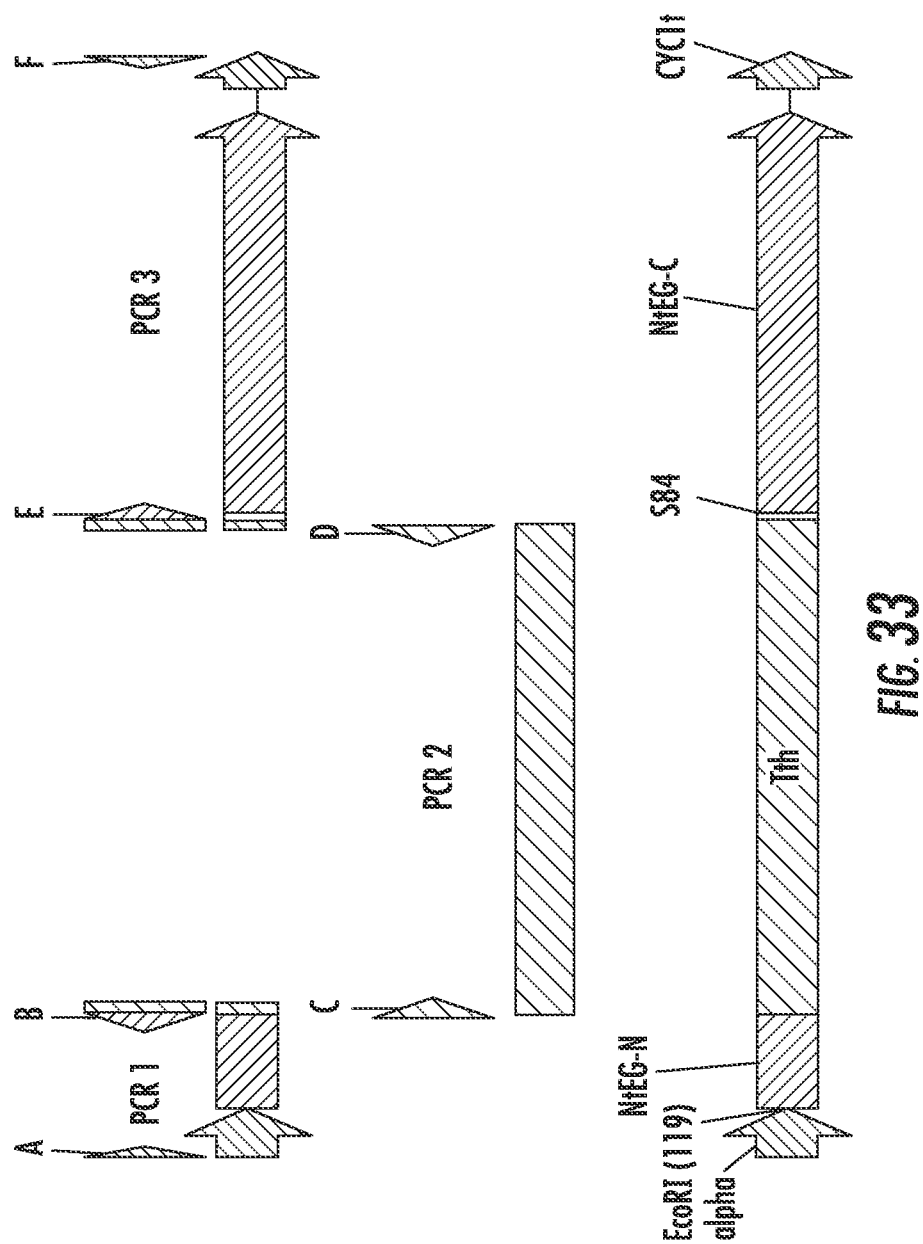
FIG. 33 illustrates a strategy for assembling genes encoding intein-modified NtEG endoglucanases.

A series of protein fusions with the Tth intein inserted into NtEG at different positions were made. The intein insertion site was determined by the method described herein and was typically adjacent to serines, threonines, or cysteines. Coding sequences for the recombinant NtEG proteins were then assembled via an SOE PCR strategy as depicted in FIG. 33 (see also example 6b). As shown in FIG. 33, primers were designed to anneal to:
(A) the sequence encoding the alpha signal peptide in pAL410 NtEGm;
(B) a region within the coding sequence for NtEGm that is adjacent to the insertion site (in this case, serine 84);
(C) the 5' end of the coding sequence for the Tth intein;
(D) the 3' end of the coding sequence for the Tth intein;
(E) a region within the coding sequence for NtEGm that is adjacent to the insertion site (in this example, this site does not overlap that covered by primer C); and
(F) a region within the CYC terminator sequence from pAL410 NtEGm.
PCR1 employs primers A and B to assemble a short product that includes the coding sequences for a portion of the alpha signal factor as well as the N-terminal portion of the endoglucanase (NtEG-N). The extreme 3' end of PCR product 1 includes a short segment that is homologous to the extreme 5' end of the Tth intein. PCR2 employs primers C and D to amplify the coding sequence of the Tth intein. PCR3 employs primers E and F to amplify the coding sequences for the C-terminal portion of the endoglucanase (NtEG-C), including the "C+1" amino acid (in this case serine 84) and a short segment that is homologous to the extreme 5' end of the Tth intein, as well as a portion of the CYC1 terminator (CYClt) from pAL410. PCR products 1, 2, and 3 were then combined in a single PCR reaction; and by virtue of their homology to the ends of the Tth intein, PCR products 1 and 3 annealed to PCR product 2. DNA synthesis and amplification with the outermost primers (A and F) lead to the assembly of the full-length product as indicated at the bottom of the diagram.

To prepare any desired intein-modified NtEG derivative, PCR products must be prepared that are tailored for each intein insertion position. However, some of the components in this experimental setup are modular. For example, primers C and D can be used to prepare PCR product 2, which can then be used to assemble any of the planned recombinants. Similarly, primers A and F can be used to prepare PCR products 1 and 3, respectively, regardless of the insertion position. As such, only primers B and E are unique to a given intein insertion event. Table 11, below, lists the sequences (in 5'-3' orientation) of the oligonucleotide primers that were used to assemble each of the intein-modified NtEG endoglucanases. While primers B and E are unique to each product, each contains a region that is homologous to the terminus of the Tth intein. This constant region is underlined in each primer sequence in Table 11.

TABLE 11

```
Primer A   GCTGTTTTGCCATTTTCCAACAGCA (SEQ ID: 2018)
Primer C   TGCCTGGCCGAGGGCTCGCTCGTCTTGGACGCGGCTACCG (SEQ ID: 2019)
Primer D   GTTATGCACCACCAGGTCCTCGCTCACGAAGTTTGCAAAG (SEQ ID: 2020)
Primer F   CCCAAAACCTTCTCAAGCAAGGT (SEQ ID: 2021)
```

| Insertion Site | Primer B |
|---|---|
| S84 | TCCAAGACGAGCGAGCCCTCGGCCAGGCAGTAGCCGGCCTCAAAATCTATGA (SEQ ID: 2022) |
| T303 | TCCAAGACGAGCGAGCCCTCGGCCAGGCAGCCCCACATGTCGATGTAGAGGA (SEQ ID: 2023) |
| S325 | TCCAAGACGAGCGAGCCCTCGGCCAGGCAGGCGGACAAGCCCAGCT (SEQ ID: 2024) |
| T333 | TCCAAGACGAGCGAGCCCTCGGCCAGGCATTGCGCGAACTGTCTATAAGAGGA (SEQ ID: 2025) |
| S345 | TCCAAGACGAGCGAGCCCTCGGCCAGGCAGCGGCCACCATCGCCCA (SEQ ID: 2026) |
| C348 | TCCAAGACGAGCGAGCCCTCGGCCAGGCACACAAAGGAGCGGCCACCA (SEQ ID: 2027) |
| S352 | TCCAAGACGAGCGAGCCCTCGGCCAGGCACCCGAACCCGCACACA (SEQ ID: 2028) |
| T356 | TCCAAGACGAGCGAGCCCTCGGCCAGGCAAGGAGGATTACTCCCGA (SEQ ID: 2029) |
| S362 | TCCAAGACGAGCGAGCCCTCGGCCAGGCATCTGTGGTGCGGTCTCGT (SEQ ID: 2030) |
| S363 | TCCAAGACGAGCGAGCCCTCGGCCAGGCAGGATCTGTGGTGCGGTCTCGT (SEQ ID: 2031) |
| S364 | TCCAAGACGAGCGAGCCCTCGGCCAGGCACGAGGATCTGTGGTGCGGT (SEQ ID: 2032) |
| T376 | TCCAAGACGAGCGAGCCCTCGGCCAGGCAATTCCAGTCGCAAGTAGCGGGA (SEQ ID: 2033) |
| S379 | TCCAAGACGAGCGAGCCCTCGGCCAGGCAGTTGAATGTATTCCAGTCGCA (SEQ ID: 2034) |
| S406 | TCCAAGACGAGCGAGCCCTCGGCCAGGCAACGGTCATCGACGTAGTTGTCA (SEQ ID: 2035) |
| T415 | TCCAAGACGAGCGAGCCCTCGGCCAGGCAGGCGACTTCGTTGTGAACA (SEQ ID: 2036) |

| Insertion Site | Primer E |
|---|---|
| S84 | AGGACCTGGTGGTGCATAACAGCAGTGCCGGGGCCTTGGA (SEQ ID: 2037) |
| T303 | AGGACCTGGTGGTGCATAACACCCTTCGCCACGCTGCCA (SEQ ID: 2038) |
| S325 | AGGACCTGGTGGTGCATAACTCCTCTTATAGACAGTTCGCGCAAACGCA (SEQ ID: 2039) |
| T333 | AGGACCTGGTGGTGCATAACACGCAAATCGACTACGCCCT (SEQ ID: 2040) |
| S345 | AGGACCTGGTGGTGCATAACTCCTTTGTGTGCGGGTTCGGGA (SEQ ID: 2041) |
| C348 | AGGACCTGGTGGTGCATAACTGCGGGTTCGGGAGTAATCCT (SEQ ID: 2042) |
| S352 | AGGACCTGGTGGTGCATAACAGTAATCCTCCTACGAGACCGCA (SEQ ID: 2043) |
| T356 | AGGACCTGGTGGTGCATAACACGAGACCGCACCACAGATCCT (SEQ ID: 2044) |
| S362 | AGGACCTGGTGGTGCATAACTCCTCGTCGTGCCCGCCA (SEQ ID: 2045) |
| S363 | AGGACCTGGTGGTGCATAACTCGTCGTGCCCGCCAGCT (SEQ ID: 2046) |
| S364 | AGGACCTGGTGGTGCATAACTCGTGCCCGCCAGCTCCCGCT (SEQ ID: 2047) |
| T376 | AGGACCTGGTGGTGCATAACACATTCAACTCACCTGACCCA (SEQ ID: 2048) |
| S379 | AGGACCTGGTGGTGCATAACTCACCTGACCCAAACTACCA (SEQ ID: 2049) |
| S406 | AGGACCTGGTGGTGCATAACTCAGACTATGTTCACAACGA (SEQ ID: 2050) |
| T415 | AGGACCTGGTGGTGCATAACACTGATTACAACGCGGGTTTCCA (SEQ ID: 2051) |

The insertion sites listed in Table 11 refer to the identity and relative position of the amino acid residue in the C+1 position of the extein. The numbering is relative to the amino acid sequence of the predicted NtEGm polypeptide, wherein 2-5 correspond to amino acids 17-20 (Ala-Tyr-Asp-Tyr), of the native, NtEG sequence (O77044) (SEQ ID NO: 112).

Figure 34:
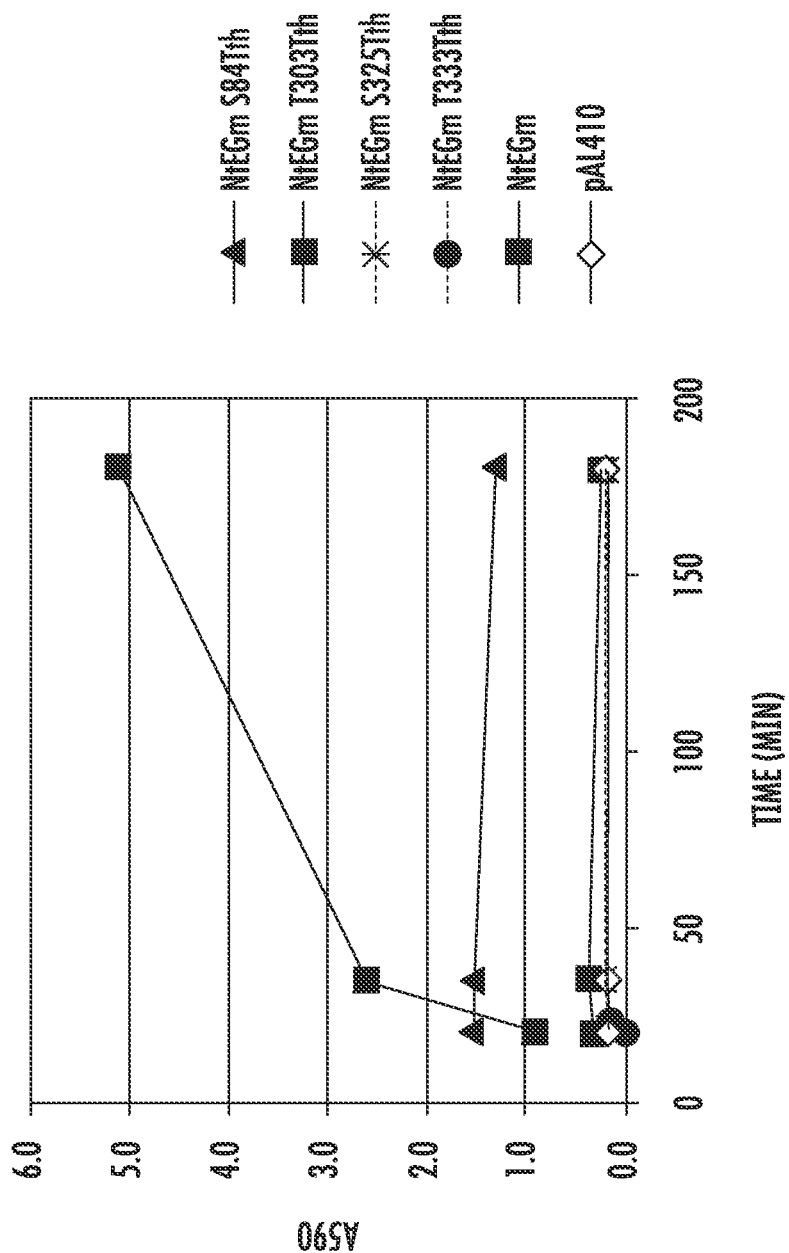
FIG. 34 illustrates a timecourse of enzyme activity from yeast cells expressing intein modified termite endoglucanases.

Using the above primers, SOE PCR reactions were carried out. A subset of these recombinant PCR products has been ligated into pCRBlunt II TOPO (Invitrogen, Carlsbad Calif.), sequenced to confirm composition, and then transferred to the pAL410 yeast expression vector. Supernatants were collected from cultures of yeast cells carrying pAL410, pAL410 NtEGm, or pAL410 NtEGm with the Tth intein inserted adjacent to serine 84, threonine 303, serine 325, or threonine 333. These supernatants were then examined in the Cellazyme C assay, and endoglucanase activity was monitored as an increase in absorbance at 590 nm (due to release of the dye from the AZCL-HE-cellulose substrate) as a function of time. FIG. 34 shows that insertion of the Tth intein into any of the four positions tested strongly reduces activity of the enzyme.

It is understood, therefore, that this invention is not limited to the particular embodiments disclosed, but is intended to cover all modifications which are within the spirit and scope of the invention as defined by the appended claims; the above description; and/or shown in the attached drawings.

SEQUENCE LISTING (2089 sequences)

SEQ ID NO: 1 - DNA, 12311 bp, Artificial Sequence
  Synthetic Construct, pAG2005
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagcccgggtattcatcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 2 - protein, 134 aa, Methanothermobacter thermautotrophicus
  Mth
CVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHN

SEQ ID NO: 3 - protein, 537 aa, Pyrococcus species GB-D
  PspPol
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHN

SEQ ID NO: 4 - protein, 167 aa, Artificial Sequence
  Synthetic Construct, mPspM1L1
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDITEDRVVEIKREYYDGYVYDLSVDEDENFLAGHGYLMAHN

SEQ ID NO: 5 - protein, 168 aa, Artificial Sequence
  Synthetic Construct, mPspM1L2
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGGDITEDRVVEIKREYYDGYVYDLSVDEDENFLAGHGYLMAHN

SEQ ID NO: 6 - protein, 169 aa, Artificial Sequence
  Synthetic Construct, mPspM1L3
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGSGDITEDRVVEIKREYYDGYVYDLSVDEDENFLAGHGYLMAHN

SEQ ID NO: 7 - protein, 170 aa, Artificial Sequence
  Synthetic Construct, mPspM1L4
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSGDITEDRVVEIKREYYDGYVYDLSVDEDENFLAGHGYLMAHN

SEQ ID NO: 8 - protein, 171 aa, Artificial Sequence
  Synthetic Construct, mPspM1L5
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDSNGDITEDRVVEIKREYYDGYVYDLSVDEDENFLAGHGYLMAHN

SEQ ID NO: 9 - protein, 172 aa, Artificial Sequence
  Synthetic Construct, mPspM1L6
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSDSGDITEDRVVEIKREYYDGYVYDLSVDEDENFLAGHGYLMAHN

SEQ ID NO: 10 - protein, 173 aa, Artificial Sequence
  Synthetic Construct, mPspM1L7
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSSGDSGNGDITEDRVVEIKREYYDGYVYDLSVDEDENFLAGHGYLMAHN

SEQ ID NO: 11 - protein, 167 aa, Artificial Sequence
  Synthetic Construct, mPspM2L1
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDITNDRVVEIKREYYDGYVYDLSVDEDENFLAGHGYLMAHN

SEQ ID NO: 12 - protein, 168 aa, Artificial Sequence
  Synthetic Construct, mPspM2L2
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGGDITNDRVVEIKREYYDGYVYDLSVDEDENFLAGHGYLMAHN

SEQ ID NO: 13 - protein, 169 aa, Artificial Sequence
  Synthetic Construct, mPspM2L3
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGSGDITNDRVVEIKREYYDGYVYDLSVDEDENFLAGHGYLMAHN

SEQ ID NO: 14 - protein, 170 aa, Artificial Sequence
  Synthetic Construct, mPspM2L4
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSGDITNDRVVEIKREYYDGYVYDLSVDEDENFLAGHGYLMAHN

SEQ ID NO: 15 - protein, 171 aa, Artificial Sequence
  Synthetic Construct, mPspM2L5
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDSNGDITNDRVVEIKREYYDGYVYDLSVDEDENFLAGHGYLMAHN

SEQ ID NO: 16 - protein, 172 aa, Artificial Sequence
  Synthetic Construct, mPspM2L6
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSDSGDITNDRVVEIKREYYDGYVYDLSVDEDENFLAGHGYLMAHN

SEQ ID NO: 17 - protein, 173 aa, Artificial Sequence
  Synthetic Construct, mPspM2L7
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSSGDSGNGDITNDRVVEIKREYYDGYVYDLSVDEDENFLAGHGYLMAHN

SEQ ID NO: 18 - protein, 167 aa, Artificial Sequence
  Synthetic Construct, mPspM3L1
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDITEDRVVEIKREYYDGYVYDLSVDEDENFNAGHGYLMAHN

SEQ ID NO: 19 - protein, 168 aa, Artificial Sequence
  Synthetic Construct, mPspM3L2
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGGDITEDRVVEIKREYYDGYVYDLSVDEDENFNAGHGYLMAHN

SEQ ID NO: 20 - protein, 169 aa, Artificial Sequence
  Synthetic Construct, mPspM3L3
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGSGDITEDRVVEIKREYYDGYVYDLSVDEDENFNAGHGYLMAHN

SEQ ID NO: 21 - protein, 170 aa, Artificial Sequence
  Synthetic Construct, mPspM3L4
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSGDITEDRVVEIKREYYDGYVYDLSVDEDENFNAGHGYLMAHN

SEQ ID NO: 22 - protein, 171 aa, Artificial Sequence
  Synthetic Construct, mPspM3L5
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDSNGDITEDRVVEIKREYYDGYVYDLSVDEDENFNAGHGYLMAHN

SEQ ID NO: 23 - protein, 172 aa, Artificial Sequence
  Synthetic Construct, mPspM3L6
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSDSGDITEDRVVEIKREYYDGYVYDLSVDEDENFNAGHGYLMAHN

SEQ ID NO: 24 - protein, 173 aa, Artificial Sequence
  Synthetic Construct, mPspM3L7
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSSGDSGNGDITEDRVVEIKREYYDGYVYDLSVDEDENFNAGHGYLMAHN

SEQ ID NO: 25 - protein, 167 aa, Artificial Sequence
  Synthetic Construct, mPspM4L1
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDITNDRVVEIKREYYDGYVYDLSVDEDENFNAGHGYLMAHN

SEQ ID NO: 26 - protein, 168 aa, Artificial Sequence
  Synthetic Construct, mPspM4L2
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGGDITNDRVVEIKREYYDGYVYDLSVDEDENFNAGHGYLMAHN

SEQ ID NO: 27 - protein, 169 aa, Artificial Sequence
  Synthetic Construct, mPspM4L3
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGSGDITNDRVVEIKREYYDGYVYDLSVDEDENFNAGHGYLMAHN

SEQ ID NO: 28 - protein, 170 aa, Artificial Sequence
  Synthetic Construct, mPspM4L4
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSGDITNDRVVEIKREYYDGYVYDLSVDEDENFNAGHGYLMAHN

SEQ ID NO: 29 - protein, 171 aa, Artificial Sequence
  Synthetic Construct, mPspM4L5
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDSNGDITNDRVVEIKREYYDGYVYDLSVDEDENFNAGHGYLMAHN

SEQ ID NO: 30 - protein, 172 aa, Artificial Sequence
  Synthetic Construct, mPspM4L6
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSDSGDITNDRVVEIKREYYDGYVYDLSVDEDENFNAGHGYLMAHN

SEQ ID NO: 31 - protein, 173 aa, Artificial Sequence
  Synthetic Construct, mPspM4L7
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSSGDSGNGDITNDRVVEIKREYYDGYVYDLSVDEDENFNAGHGYLMAHN

SEQ ID NO: 32 - protein, 167 aa, Artificial Sequence
  Synthetic Construct, mPspM5L1
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSGDITEDRVVEIKREYYDGYVYDLSVDEDENFLAGHGYLMAHN

SEQ ID NO: 33 - protein, 168 aa, Artificial Sequence
  Synthetic Construct, mPspM5L2
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSGGDITEDRVVEIKREYYDGYVYDLSVDEDENFLAGHGYLMAHN

SEQ ID NO: 34 - protein, 169 aa, Artificial Sequence
  Synthetic Construct, mPspM5L3
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSGSGDITEDRVVEIKREYYDGYVYDLSVDEDENFLAGHGYLMAHN

SEQ ID NO: 35 - protein, 170 aa, Artificial Sequence
  Synthetic Construct, mPspM5L4
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSNGSGDITEDRVVEIKREYYDGYVYDLSVDEDENFLAGHGYLMAHN

SEQ ID NO: 36 - protein, 171 aa, Artificial Sequence
  Synthetic Construct, mPspM5L5
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSGDSNGDITEDRVVEIKREYYDGYVYDLSVDEDENFLAGHGYLMAHN

SEQ ID NO: 37 - protein, 172 aa, Artificial Sequence
  Synthetic Construct, mPspM5L6
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSNGSDSGDITEDRVVEIKREYYDGYVYDLSVDEDENFLAGHGYLMAHN

SEQ ID NO: 38 - protein, 173 aa, Artificial Sequence
  Synthetic Construct, mPspM5L7
SILPEEWVPLIKNGKVKTFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDNLAVPRSSGDSGNGDITEDRVVEIKREYYDGYVYDLSVDEDENFLAGHGYLMAHN

SEQ ID NO: 39 - protein, 167 aa, Artificial Sequence
  Synthetic Construct, mPspM6L1
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDITEDRVVEIKREYYDGYVYDLSVDEDENFLAGFGFLMAHN

SEQ ID NO: 40 - protein, 168 aa, Artificial Sequence
  Synthetic Construct, mPspM6L2
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGGDITEDRVVEIKREYYDGYVYDLSVDEDENFLAGFGFLMAHN

SEQ ID NO: 41 - protein, 169 aa, Artificial Sequence
  Synthetic Construct, mPspM6L3
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGSGDITEDRVVEIKREYYDGYVYDLSVDEDENFLAGFGFLMAHN

SEQ ID NO: 42 - protein, 170 aa, Artificial Sequence
  Synthetic Construct, mPspM6L4
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSGDITEDRVVEIKREYYDGYVYDLSVDEDENFLAGFGFLMAHN

SEQ ID NO: 43 - protein, 171 aa, Artificial Sequence
  Synthetic Construct, mPspM6L5
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSGDSNGDITEDRVVEIKREYYDGYVYDLSVDEDENFLAGFGFLMAHN

SEQ ID NO: 44 - protein, 172 aa, Artificial Sequence
  Synthetic Construct, mPspM6L6
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSNGSDSGDITEDRVVEIKREYYDGYVYDLSVDEDENFLAGFGFLMAHN

SEQ ID NO: 45 - protein, 173 aa, Artificial Sequence
  Synthetic Construct, mPspM6L7
SILPEEWVPLTKNGKSKIFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDNLAVPRSSGDSGNGDITEDRVVEIKREYYDGYVYDLSVDEDENFLAGFGFLMAHN

SEQ ID NO: 46 - protein, 167 aa, Artificial Sequence
  Synthetic Construct, mPspM7L1
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSGDITEDRVVEIKREYYDGYVYDLSVDEDENFLAGHGYLMAHN

SEQ ID NO: 47 - protein, 168 aa, Artificial Sequence
  Synthetic Construct, mPspM7L2
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSGGDITEDRVVEIKREYYDGYVYDLSVDEDENFLAGHGYLMAHN

SEQ ID NO: 48 - protein, 169 aa, Artificial Sequence
  Synthetic Construct, mPspM7L3
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSGSGDITEDRVVEIKREYYDGYVYDLSVDEDENFLAGHGYLMAHN

SEQ ID NO: 49 - protein, 170 aa, Artificial Sequence
  Synthetic Construct, mPspM7L4
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSNGSGDITEDRVVEIKREYYDGYVYDLSVDEDENFLAGHGYLMAHN

SEQ ID NO: 50 - protein, 171 aa, Artificial Sequence
  Synthetic Construct, mPspM7L5
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSGDSNGDITEDRVVEIKREYYDGYVYDLSVDEDENFLAGHGYLMAHN

SEQ ID NO: 51 - protein, 172 aa, Artificial Sequence
  Synthetic Construct, mPspM7L6
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSNGSDSGDITEDRVVEIKREYYDGYVYDLSVDEDENFLAGHGYLMAHN

SEQ ID NO: 52 - protein, 173 aa, Artificial Sequence
  Synthetic Construct, mPspM7L7
SILPEEWVPLTKNGKSKTFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDNLAVPRSSGDSGNGDITEDRVVEIKREYYDGYVYDLSVDEDENFLAGHGYLMAHN

SEQ ID NO: 53 - protein, 167 aa, Artificial Sequence
  Synthetic Construct, mPspM8L1
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSGDIVLDRVVEIKREYYDGYVYDLSVDEDENFLAGHGYLMAHN

SEQ ID NO: 54 - protein, 168 aa, Artificial Sequence
  Synthetic Construct, mPspM8L2
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSGGDIVLDRVVEIKREYYDGYVYDLSVDEDENFLAGHGYLMAHN

SEQ ID NO: 55 - protein, 169 aa, Artificial Sequence
  Synthetic Construct, mPspM8L3
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSGSGDIVLDRVVEIKREYYDGYVYDLSVDEDENFLAGHGYLMAHN

SEQ ID NO: 56 - protein, 170 aa, Artificial Sequence
  Synthetic Construct, mPspM8L4
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSNGSGDIVLDRVVEIKREYYDGYVYDLSVDEDENFLAGHGYLMAHN

SEQ ID NO: 57 - protein, 171 aa, Artificial Sequence
  Synthetic Construct, mPspM8L5
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSGDSNGDIVLDRVVEIKREYYDGYVYDLSVDEDENFLAGHGYLMAHN

SEQ ID NO: 58 - protein, 172 aa, Artificial Sequence
  Synthetic Construct, mPspM8L6
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSNGSDSGDIVLDRVVEIKREYYDGYVYDLSVDEDENFLAGHGYLMAHN

SEQ ID NO: 59 - protein, 173 aa, Artificial Sequence
  Synthetic Construct, mPspM8L7
SILPEEWVPLTKNGKSKTFRIGDFVDGLMKANQGKVKKTGDTEVLEVAGIHANSFDRKSKKSRTMAVKAVIRHRYSGNVYRIVLNSGRKITITEGHSLFVYRNGDLVEATGEDVKIGDLLAVPRSSGDSGNGDIVLDRVVEIKREYYDGYVYDLSVDEDENFLAGHGYLMAHN

SEQ ID NO: 60 - protein, 167 aa, Artificial Sequence
  Synthetic Construct, mPspM9L1
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSGDIVLDRVVEIKREYYDGYVYDLSVDEDENFLAGFGFLMAHN

SEQ ID NO: 61 - protein, 168 aa, Artificial Sequence
  Synthetic Construct, mPspM9L2
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSGGDIVLDRVVEIKREYYDGYVYDLSVDEDENFLAGFGFLMAHN

SEQ ID NO: 62 - protein, 169 aa, Artificial Sequence
  Synthetic Construct, mPspM9L3
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSGSGDIVLDRVVEIKREYYDGYVYDLSVDEDENFLAGFGFLMAHN

SEQ ID NO: 63 - protein, 170 aa, Artificial Sequence
  Synthetic Construct, mPspM9L4
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSNGSGDIVLDRVVEIKREYYDGYVYDLSVDEDENFLAGFGFLMAHN

SEQ ID NO: 64 - protein, 171 aa, Artificial Sequence
  Synthetic Construct, mPspM9L5
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSGDSNGDIVLDRVVEIKREYYDGYVYDLSVDEDENFLAGFGFLMAHN

SEQ ID NO: 65 - protein, 172 aa, Artificial Sequence
  Synthetic Construct, mPspM9L6
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSNGSDSGDIVLDRVVEIKREYYDGYVYDLSVDEDENFLAGFGFLMAHN

SEQ ID NO: 66 - protein, 173 aa, Artificial Sequence
  Synthetic Construct, mPspM9L7
SILPEEWVPLTKNGKSKIFRIGDFVDGLMKANQGKVKKTGDTEVLEVAGIHAFSFDRKSKKARTMAVKAVIRHRYSGNVYRIVLNSGRKITITEGHSLFVYRNGDLVEATGEDVKIGDLLAVPRSSGDSGNGDIVLDRVVEIKREYYDGYVYDLSVDEDENFLAGFGFLMAHN

SEQ ID NO: 67 - protein, 167 aa, Artificial Sequence
  Synthetic Construct, mPspM10L1
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSGDIVLDRVVEIKREYYDGYVYDLSVDEDENFLAGHGYLMAHN

SEQ ID NO: 68 - protein, 168 aa, Artificial Sequence
  Synthetic Construct, mPspM10L2
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSGGDIVLDRVVEIKREYYDGYVYDLSVDEDENFLAGHGYLMAHN

SEQ ID NO: 69 - protein, 169 aa, Artificial Sequence
  Synthetic Construct, mPspM10L3
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSGSGDIVLDRVVEIKREYYDGYVYDLSVDEDENFLAGHGYLMAHN

SEQ ID NO: 70 - protein, 170 aa, Artificial Sequence
  Synthetic Construct, mPspM10L4
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSNGSGDIVLDRVVEIKREYYDGYVYDLSVDEDENFLAGHGYLMAHN

SEQ ID NO: 71 - protein, 171 aa, Artificial Sequence
  Synthetic Construct, mPspM10L5
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSGDSNGDIVLDRVVEIKREYYDGYVYDLSVDEDENFLAGHGYLMAHN

SEQ ID NO: 72 - protein, 172 aa, Artificial Sequence
  Synthetic Construct, mPspM10L6
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSNGSDSGDIVLDRVVEIKREYYDGYVYDLSVDEDENFLAGHGYLMAHN

SEQ ID NO: 73 - protein, 173 aa, Artificial Sequence
  Synthetic Construct, mPspM10L7
SILPEEWVPLIKNGKVKTFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSSGDSGNGDIVLDRVVEIKREYYDGYVYDLSVDEDENFLAGHGYLMAHN

SEQ ID NO: 74 - protein, 167 aa, Artificial Sequence
  Synthetic Construct, mPspM11L1
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSGDIVLDRVVEIKREYYDGYVYDLSVDEDENFLAGFGFLMAHN

SEQ ID NO: 75 - protein, 168 aa, Artificial Sequence
  Synthetic Construct, mPspM11L2
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSGGDIVLDRVVEIKREYYDGYVYDLSVDEDENFLAGFGFLMAHN

SEQ ID NO: 76 - protein, 169 aa, Artificial Sequence
  Synthetic Construct, mPspM11L3
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSGSGDIVLDRVVEIKREYYDGYVYDLSVDEDENFLAGFGFLMAHN

SEQ ID NO: 77 - protein, 170 aa, Artificial Sequence
  Synthetic Construct, mPspM11L4
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSNGSGDIVLDRVVEIKREYYDGYVYDLSVDEDENFLAGFGFLMAHN

SEQ ID NO: 78 - protein, 171 aa, Artificial Sequence
  Synthetic Construct, mPspM11L5
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSGDSNGDIVLDRVVEIKREYYDGYVYDLSVDEDENFLAGFGFLMAHN

SEQ ID NO: 79 - protein, 172 aa, Artificial Sequence
  Synthetic Construct, mPspM11L6
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSNGSDSGDIVLDRVVEIKREYYDGYVYDLSVDEDENFLAGFGFLMAHN

SEQ ID NO: 80 - protein, 173 aa, Artificial Sequence
  Synthetic Construct, mPspM11L7
SILPEEWVPLIKNGKVKIFRIGDFVDGLMKANQGKVKKTGDTEVLEVAGIHANSFDRKSKKSRVMAVKAVIRHRYSGNVYRIVLNSGRKITITEGHSLFVYRNGDLVEATGEDVKIGDLLAVPRSSGDSGNGDIVLDRVVEIKREYYDGYVYDLSVDEDENFLAGFGFLMAHN

SEQ ID NO: 81 - protein, 167 aa, Artificial Sequence
  Synthetic Construct, mPspM12L1
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSGDITEDRVVEIKREYYDGYVYDLSVDEDENFLAGFGFLMAHN

SEQ ID NO: 82 - protein, 168 aa, Artificial Sequence
  Synthetic Construct, mPspM12L2
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSGGDITEDRVVEIKREYYDGYVYDLSVDEDENFLAGFGFLMAHN

SEQ ID NO: 83 - protein, 169 aa, Artificial Sequence
  Synthetic Construct, mPspM12L3
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSGSGDITEDRVVEIKREYYDGYVYDLSVDEDENFLAGFGFLMAHN

SEQ ID NO: 84 - protein, 170 aa, Artificial Sequence
  Synthetic Construct, mPspM12L4
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSNGSGDITEDRVVEIKREYYDGYVYDLSVDEDENFLAGFGFLMAHN

SEQ ID NO: 85 - protein, 171 aa, Artificial Sequence
  Synthetic Construct, mPspM12L5
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSGDSNGDITEDRVVEIKREYYDGYVYDLSVDEDENFLAGFGFLMAHN

SEQ ID NO: 86 - protein, 172 aa, Artificial Sequence
  Synthetic Construct, mPspM12L6
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSNGSDSGDITEDRVVEIKREYYDGYVYDLSVDEDENFLAGFGFLMAHN

SEQ ID NO: 87 - protein, 173 aa, Artificial Sequence
  Synthetic Construct, mPspM12L7
SILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDNLAVPRSSGDSGNGDITEDRVVEIKREYYDGYVYDLSVDEDENFLAGFGFLMAHN

SEQ ID NO: 88 - protein, 168 aa, Artificial Sequence
  Synthetic Construct, RecA
CLAEGTRIFDPVTGTTHRIEDVVDGRKPIHVVAAAKDGTLHARPVVSWFDQGTRDVIGLRIAGGAIVWATPDHKVLTEYGWRAAGELRKGDRVAQPRRFDGFGDSAPIPARVQALADALDDKFLHDMLAEELRYSVIREVLPTRRARTFDLEVEELHTLVAEGVVVHN

SEQ ID NO: 89 - protein, 173 aa, Thermoplasma acidophilum, ATCC 25905
  Tac
CVSGDTPVLLDAGERRIGDLFMEAIRPKERGEIGQNEEIVRLHDSWRIYSMVGSEIVETVSHAIYHGKSNAIVNVRTENGREVRVTPVHKLFVKIGNSVIERPASEVNEGDEIAWPSVSENGDSQTVTTTLVLTFDRVVSKEMHSGVFDVYDLMVPDYGYNFIGGNGLIVLHN

SEQ ID NO: 90 - protein, 157 aa, Thermococcus aggregans
  Tag
SVTGDTEIIVKRNGRIEFVPIEKLFERVDYRIGEKEYCILEDVEALTLDNRGKLIWKKVPYVMRHRAKKKVYRIWITNSWYIDVTEDHSLIVAEDGLKEARPMEIEGKSLIATKDDLSGVEYIKPHAIEEISYNGYVYDIEVEGTHRFFANGILVHN

SEQ ID NO: 91 - protein, 423 aa, Thermus thermophilus HB27
  Tth
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 92 - protein, 135 aa, Artificial Sequence
  Synthetic Construct, mTth001
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGTDGDVLWDPIVAVEPAGKARTFDLRVPPFANFVSEDLVVHN

SEQ ID NO: 93 - protein, 135 aa, Artificial Sequence
  Synthetic Construct, mTth002
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPDQKVLWDPIVAVEPAGKARTFDLRVPPFANFVSEDLVVHN

SEQ ID NO: 94 - protein, 135 aa, Artificial Sequence
  Synthetic Construct, mTth003
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPEPGKGVLWDPIVAVEPAGKARTFDLRVPPFANFVSEDLVVHN

SEQ ID NO: 95 - protein, 135 aa, Artificial Sequence
  Synthetic Construct, mTth004
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPDSEGNVLWDPIVAVEPAGKARTFDLRVPPFANFVSEDLVVHN

SEQ ID NO: 96 - protein, 135 aa, Artificial Sequence
  Synthetic Construct, mTth005
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPSSDGLVLWDPIVAVEPAGKARTFDLRVPPFANFVSEDLVVHN

SEQ ID NO: 97 - protein, 135 aa, Artificial Sequence
  Synthetic Construct, mTth006
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPNNIVLWDPIVAVEPAGKARTFDLRVPPFANFVSEDLVVHN

SEQ ID NO: 98 - protein, 135 aa, Artificial Sequence
  Synthetic Construct, mTth007
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGETNGVLWDPIVAVEPAGKARTFDLRVPPFANFVSEDLVVHN

SEQ ID NO: 99 - protein, 135 aa, Artificial Sequence
  Synthetic Construct, mTth008
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPQEGVGVLWDPIVAVEPAGKARTFDLRVPPFANFVSEDLVVHN

SEQ ID NO: 100 - protein, 165 aa, Artificial Sequence
  Synthetic Construct, mTth009
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPRRFDGFGDSAPIPARVQALADALDDKFLHDMLAEEVLWDPIVAVEPAGKARTFDLRVPPFANFVSEDLVVHN

SEQ ID NO: 101 - protein, 136 aa, Artificial Sequence
  Synthetic Construct, mTth010
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHN

SEQ ID NO: 102 - protein, 184 aa, Artificial Sequence
  Synthetic Construct, mTth011
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPRSAFSVDCAGFARGKPEFAPTTYTVGVPGLVRFLEAHHRDPDAQAIADELTDGRVLWDPIVAVEPAGKARTFDLRVPPFANFVSEDLVVHN

SEQ ID NO: 103 - protein, 172 aa, Artificial Sequence
  Synthetic Construct, mTth012
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPKCLPSSNLQLMSDAELGFIDERTGKLAQVVKSKTVALLANSDVLWDPIVAVEPAGKARTFDLRVPPFANFVSEDLVVHN

SEQ ID NO: 104 - protein, 360 aa, Dictyoglomus thermophilum
  P77853
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 105 - protein, 1077 aa, Clostridium thermocellum
  P51584
MKNKRVLAKITALVVLLGVFFVLPSNISQLYADYEVVHDTFEVNFDGWCNLGVDTYLTAVENEGNNGTRGMMVINRSSASDGAYSEKGFYLDGGVEYKYSVFVKHNGTGTETFKLSVSYLDSETEEENKEVIATKDVVAGEWTEISAKYKAPKTAVNITLSITTDSTVDFIFDDVTITRKGMAEANTVYAANAVLKDMYANYFRVGSVLNSGTVNNSSIKALILREFNSITCENEMKPDATLVQSGSTNTNIRVSLNRAASILNFCAQNNIAVRGHTLVWHSQTPQWFFKDNFQDNGNWVSQSVMDQRLESYIKNMFAEIQRQYPSLNLYAYDVVNEAVSDDANRTRYYGGAREPGYGNGRSPWVQIYGDNKFIEKAFTYARKYAPANCKLYYNDYNEYWDHKRDCIASICANLYNKGLLDGVGMQSHINADMNGFSGIQNYKAALQKYINIGCDVQITELDISTENGKFSLQQQADKYKAVFQAAVDINRTSSKGKVTAVCVWGPNDANTWLGSQNAPLLFNANNQPKPAYNAVASIIPQSEWGDGNNPAGGGGGGKPEEPDANGYYYHDTFEGSVGQWTARGPAEVLLSGRTAYKGSESLLVRNRTAAWNGAQRALNPRTFVPGNTYCFSVVASFIEGASSTTFCMKLQYVDGSGTQRYDTIDMKTVGPNQWVHLYNPQYRIPSDATDMYVYVETADDTINFYIDEAIGAVAGTVIEGPAPQPTQPPVLLGDVNGDGTINSTDLTMLKRSVLRAITLTDDAKARADVDKNGSINSTDVLLLSRYLLRVIDKFPVAENPSSSFKYESAVQYRPAPDSYLNPCPQAGRIVKETYTGINGTKSLNVYLPYGYDPNKKYNIFYLMHGGGENENTIFSNDVKLQNILDHAIMNGELEPLIVVTPTFNGGNCTAQNFYQEFRQNVIPFVESKYSTYAESTTPQGIAASRMHRGFGGFSMGGLTTWYVMVNCLDYVAYFMPLSGDYWYGNSPQDKANSIAEAINRSGLSKREYFVFAATGSDHIAYANMNPQIEAMKALPHFDYTSDFSKGNFYFLVAPGATHWWGYVRHYIYDALPYFFHE

SEQ ID NO: 106 - protein, 405 aa, Bacillus sp. NG-27
  O30700
MLKTLRKPFIAGLALSLLLTGGASSVFAQGNGQAGPPKGGIFKEGEKGNGNVQPFAWQVASLADRYEESFDIGAAVEPHQLNGRQGKVLKHHYNSIVAENAMKPISLQPEEGVFTWDGADAIVEFARKNNMNLRFHTLVWHNQVPDWFFLDEEGNPMVEETNEAKRQANKELLLERLETHIKTVVERYKDDVTAWDVVNEVVDDGTPNERGLRESVWYQITGDEYIRVAFETARKYAGEDAKLFINDYNTEVTPKRDHLYNLVQDLLADGVPIDGVGHQAHIQIDWPTIDEIRTSMEMFAGLGLDNQVTELDVSLYGWPPRPAFPTYDAIPQERFQAQADRYNQLFELYEELDADLSSVTFWGIADNHTWLDDRAREYNDGVGKDAPFVFDPNYRVKPAFWRIID

SEQ ID NO: 107 - protein, 225 aa, Thermomyces lanuginosus
  O43097
MVGFTPVALAALAATGALAFPAGNATELEKRQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 108 - protein, 387 aa, Clostridium stercorarium
  P40942
MNKFLNKKWSLILTMGGIFLMATLSLIFATGKKAFNDQTSAEDIPSLAEAFRDYFPIGAAIEPGYTTGQIAELYKKHVNMLVAENAMKPASLQPTEGNFQWADADRIVQFAKENGMELRFHTLVWHNQTPTGFSLDKEGKPMVEETDPQKREENRKLLLQRLENYIRAVVLRYKDDIKSWDVVNEVIEPNDPGGMRNSPWYQITGTEYIEVAFRATREAGGSDIKLYINDYNTDDPVKRDILYELVKNLLEKGVPIDGVGHQTHIDIYNPPVERIIESIKKFAGLGLDNIITELDMSIYSWNDRSDYGDSIPDYILTLQAKRYQELFDALKENKDIVSAVVFWGISDKYSWLNGFPVKRTNAPLLFDRNFMPKPAFWAIVDPSRLRE

SEQ ID NO: 109 - protein, 895 aa, Clostridium thermocellum (strain ATCC 27405 / DSM 1237)
  O68438
MNFRRMLCAAIVLTIVLSIMLPSTVFALEDKSPKLPDYKNDLLYERTFDEGLCFPWHTCEDSGGKCDFAVVDVPGEPGNKAFRLTVIDKGQNKWSVQMRHRGITLEQGHTYTVRFTIWSDKSCRVYAKIGQMGEPYTEYWNNNWNPFNLTPGQKLTVEQNFTMNYPTDDTCEFTFHLGGELAAGTPYYVYLDDVSLYDPRFVKPVEYVLPQPDVRVNQVGYLPFAKKYATVVSSSTSPLKWQLLNSANQVVLEGNTIPKGLDKDSQDYVHWIDFSNFKTEGKGYYFKLPTVNSDTNYSHPFDISADIYSKMKFDALAFFYHKRSGIPIEMPYAGGEQWTRPAGHIGVAPNKGDTNVPTWPQDDEYAGRPQKYYTKDVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPSADIQKARNNIAKAADKWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITINWNAPFAWVTAYLDEIDLITPPGGVDPEEPEVIYGDCNGDGKVNSTDAVALKRYILRSGISINTDNADVNADGRVNSTDLAILKRYILKEIDVLPHK

SEQ ID NO: 110 - protein, 441 aa, Thermomonospora fusca
  P26222
MSPRPLRALLGAAAAALVSAAALAFPSQAAANDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 111 - protein, 562 aa, Acidothermus cellulolyticus (strain ATCC 43068 / 11B)
  P54583
MPRALRRVPGSRVMLRVGVVVAVLALVAALANLAVPRPARAAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 112 - protein, 448 aa, Nasutitermes takasagoensis
  O77044
MRVFLCLLSALALCQAAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 113 - protein, 346 aa, Aquifex aeolicus strain VF5
  Aae RIR2 intein
CFIEGTEVLTKRGFVDFRELREDDLVAQYDIETGEISWTKPYAYVERDYEGSMYRLKHPKSNWEVVATEGHEFIVRNLKTGKERKEPIEKVKLHPYSAIPVAGRYTGEVEEYDLWELVSGKGITLKTRSAVKNKLTPIEKLLIVLQADGTIDSKRNGKFTGFQQLKFFFSKYRKINEFEKILNECAPYGIKWKKYERQDGIAYTVYYPNDLPIKPTKFFDEWVRLDEITEEWIREFVEELVKWDGHIPKDRNKKKVYYYSTKEKRNKDFVQALCALGGMRTVVSRERNPKAKNPVYRIWIYLEDDYINTQTMVKEEFYYKGKVYCVSVPKGNIVVRYKDSVCIAGN

SEQ ID NO: 114 - protein, 333 aa, Acidovorax avenae subsp. citrulli AAC00-1
  Aave Hyp-1721 intein
CVDDTTEALTQRGWVGPDHLVPGDMLASFDMTTERLIWAPMASVHIFDHDGEMVHAKSKTLDMLMTPDHRVVHYKRKRTKGAQRGTTHWELGVAEAQDIPASHRVQIPTAAPFDHLPTGEPITDAQARVLGWVVTEGWFTKKNRGREEWGGALKLYQNEGRTADLIRADLDAAGLEYTETTWNYVGGNAAHIRFNIKKSSAAVLRKMLPGKQLTPALLMRMTKAQIELLVDRMIEGDGSESAAGQRCLIQNPGQTLETFQMALTILGKSFRVSKHGPSCRKVLIRESQRTENGRYSVKESERVRYTGRVWCPIVPGTSTWVARRNGMPFITHN

SEQ ID NO: 115 - protein, 388 aa, Acidovorax avenae subsp. citrulli AAC00-1
  Aave RIR intein
CVTADTWVMTDAGPAQVADLVGRPFTAIVDGRAFPTLSAGFFATGHKPVLRLRTRQGHALRLTEDHLVRRVAKQTRYVRELEWVAAGALQPGDDIVLNDHRALPGWRGEGTGAEGYLLGLLIGDGTLKADKAVISVWLAQEQEEDALLVANGAPAPSSGAHGILRAAEAAAATLSHRADFRGFQRTVARSGGACAERRMASGAVRALALHMGMRPGAKTITAAMERASSAFSVGLLRGLFDTDGSVQGRQDKGVSVRLAQSNPALLQTVQRMLLRLGIASTLYPDRRTAGLRLLPDGRGGQEPYAIRAQHELVVSGDNLRVFAERIGFEDADKAERLATALSGYRRALNREPFTATVQDVLPDGHEDVYDVTVADCHAFDANGLCVHN

SEQ ID NO: 116 - protein, 165 aa, Aspergillus brevipes FRR2439
  Abr PRP8 intein
CLAKGTRLLRYDGTEIEVQDVKEGDLLLGPDGGPRRAFNIVNGEDRLYRIKIDEGIEDLVVTPNHILVLHREKKARNNEDEASAAERYDTVEMTAAEFAALSTEERSQYRAFRCPGFESPEKAVPENHSFMIQDIRLELETTEWAGFRVDKDQLYLRHDYLVLHN

SEQ ID NO: 117 - protein, 153 aa, Acidothermus cellulolyticus 11B
  Ace RIR1 intein
CQPYSAPVSTPDGPIPIGKLVDANAVGEKVFDASGVTRIVATTCNGRKPVLRIRTSGGHVLDVTPDHLVWQVVDQTAGRFVPAGQLRVGDRLEWHDRANSDAMVAAFTADSAAAAQPGQIVDILAIDELGVMPVYDIQTESGEYLSDGIRVHN

SEQ ID NO: 118 - protein, 501 aa, Alkalilimnicola ehrlichei MLHE-1
  Aeh DnaB-1 intein
CIMAGSRLVDPRTGGRVTIDELVARQEAEVLTLGDDFRLGMARPAAFVDDGIKPVYRVRTASGREIATTLTHPFLTGDGWRPLSEIGVGEHVAVPRRIPVFGRERLPEHQVKLLAYFLGDGGTTQTSPLFTNADERVRGDFTDAVTAMGGVRCVPVGSPGRTPSLRVSRCRTALQSGRDVFAKALKGAMQQLQLTGEALADALGVSKAAVSGWINARTVPAPATYQRLCATLASSGQALPGTDYADIGKNSPNPVAAFLDRHRLWGRLATEKAVPEVVFRLKRGQLALFLSRLFACDGSAFVQGNGQARISYATSSRALARDVQHLLLRFGILSKLREKRNRYPGLQHAPWELEVMDQASLRAFCEEIGIFSKEEQVRGVREALAGKRRHNNVGGLPWSVSRYVLAAKGERSWGDIYQAAGRVLPEGFNAHLTGRSARRLSRHRASELADLLQDDYLARLATSDLHWDEIVEIEYIGAHQVYDLTVDGTHNFVAEDVCVHN

SEQ ID NO: 119 - protein, 418 aa, Alkalilimnicola ehrlichei MLHE-1
  Aeh DnaB-2 intein
CVTGDTRVLLADGQRVPIRDLVGQTPEVISVNAEGRLEPAKTDLVWSVGVRPLLQVRLASGRTIRCTPEHRLRGLWDWKEARDIRVGDRLGIARELPAPKVTKRWAEHELVLLAHLVGDGSYIKGQPLRYTTASEANSEAVSRAAEAMGSTVTRHPGRGQWHQLVISGNGNRWHPQGVGKWLKQLGVFGQRSREKHLPQEVFQLDNDQLALFLRHLWATDGSITQGSAGRPRIYFSTASRHLIQDVAALLLRFGIVGRTKHITHGDGEGWFTLDISGAVQQQRYLEKIGAFGHQAHNARRALQHLRGLVENTNVDTLPEEVFNYIRERMREEGITHRQMAALRGTAYGGSAHFTFSPSRETLLSYADILNDQRLRMLANQHVFWDRVVSVEPAGEEEVFDLTVPGNACWLADGIVSHN

SEQ ID NO: 120 - protein, 377 aa, Alkalilimnicola ehrlichei MLHE-1
  Aeh Rir1 intein
CVTADTWVQTADGPRRVAALVGRRFSARVDGTDHPSGDEGFFRTATKEVVELRTAEGYRLKLTADHRVRRVSAFTRYRTETEWCEAGQLQAGDRVLLNDHRTNAEWAGRHGRNEGYLMGLLLGDGTLKSDKAVLSVWRTAAAANGVPAGLPGGVEEVMAEGLEAARSLPHRADFTGWCEVPGRGEYRLATSAIRDLALELGIRPGSKRITDGVEQGSSDFYKGFLRGLYDADGSVQGSQRKGVSVRLAQSDSDNLEAAQRMLLRLGIASTLYRDRRPAGNTVLPDGNGGSAEYATRAQHELVISGENLARFRDLIGFANSDKQARLEALLDRYQRTLNRERFVARVVAVEAAGTEEVYDVQVPGINTFDANGLHAHN

SEQ ID NO: 121 - protein, 306 aa, Acyrthosiphon pisum secondary endosymbiot phage 1
  AP-APSE1 dpol intein
CLAKGTLVLTITGWMPIEIVSQDAYVWDGIEWVRTDGSVFNGNQEVIQAYGVGMTADHQVLTEKGWKSASQSKRYNRSSCRLPDGYKLPRFRRKEINLESTLHLWTRNNHSSNRITKTKKTRYNCLLRMPKGTNNIMQKPKARNVKTPRFCCMEQHVSQMYSPFPQSMVKLWWSGNNGLQTLAKKFQQFLGRHGQDIPTRLIFRSHQQQCRLPPQKLPLGYVASTSSKYSTSTIRANSPRHNEYTGISSPNRDCSKHALLSPGKKGKSSTTSGAPKHIAEVYDLINCGPRNRFVIATPDGPLIVHN

SEQ ID NO: 122 - protein, 468 aa, Aeropyrum pernix K1
  Ape APE0745 intein
SLPPWEPIVVRRGDEVRVTSIGEFVDSFLEGEGGLDIGGLGYYTLSLDTRTLKPVWRRIRGVIKHRIRGRLLRVKASKGRSIDLTGSHSIYRISRGGGLEVVGSSDLRPGDSLVTPASVELPESAPSSINAARELWSRGVEGIFVVGLPGEAAGYRGVERSRGYDGGHAIPLETLVERYGDSVWSLVSGAKLAVSRGAAGDHPVPATIPLDTGFYLLLGFIVSAGSVDVEGGHVTVTLGPGREGYVGDVVEAVNSTAPGAGVRISSGARGMEVTIRSRVLSELLARVFGAGPGPNRDIPSIVFRAPKPMKRVFLKGLYAGGGVFDRSSGSLIYATDSRSLLNGLALLLLNVGAGGYRIDSGDSGRALALIVENAGRLDAIGEVLEHLGFHGGREAVQGVGALERATAGLAGQATVAVQRPATRGGPGVDVAGVTGLEHLEASTEFVYDLSVEGDENFFAGLGWILVHN

SEQ ID NO: 123 - protein, 351 aa, Acanthomoeba polyphaga Mimivirus
  APMV Pol intein
SVTGDTPIITRHQNGDINITTIEELGSKWKPYEIFKAHEKNSNRKFKQQSQYPTDSEVWTAKGWAKIKRVIRHKTVKKIYRVLTHTGCIDVTEDHSLLDPNQNIIKPINCQIGTELLHGFPESNNVYDNISEQEAYVWGFFMGDGSCGSYQTKNGIKYSWALNNQDLDVLNKCKKYLEETENIQFKILDTMKSSSVYKLVPIRKIKYMVNKYRKIFYDNKKYKLVPKEILNSTKDIKNSFLEGYYAADGSRKETENMGCRRCDIKGKISAQCLFYLLKSLGYNVSINIRSDKNQIYRLTFSNKKQRKNPIAIKKIQLMNETSNDHDGDYVYDLETESGSFHAGVGEMIVKN

SEQ ID NO: 124 - protein, 347 aa, Burkholderia cenocepacia
  Bce DnaB intein
AQPLDARVRTLTGWKPMGELTVGDALASVDGAPSIVTGIYPQGERQVYRVRFSDGRSAECCDEHLWCVHFREWEKPRVLSTAEIRTLLTRERYRNRLWIDMPSGEFGHREVLPVDPWVLGALLGDGALGGTAVRFSVKAEETLNRMRERVDASLELEYAGQYDWRIKRRPSTATAARPSANPLKAALEQLGVWGRTSYDKFIPRLYLDADKDTRLDVLRGLLDADGWVESWGTVRYSTASAQLASDVRELARSLGAWCQVAEKATSFTVDGERKAGATAYICTISHPDPQNLFLFEGKRERLTAGRTRRKLPVITGIEPSRRTATQCISVSHPSRLYVTDDYVVTHN

SEQ ID NO: 125 - protein, 488 aa, Batrachochytrium dendrobatidis JEL197
  Bde-JEL197 RPB2 intein
CLSGDTEVVLGNGMDVVLLTDLVDGACVSTIEPRTGVVSPSLIDHYFAKDATRVLKITLDDGRVIKADPEHPLFAAKVDETTRGLTGQWLRVEELTVGHHALLVSPQQAYCTSEQWTLTLSEKEVCTASTAQLAKQLSEIGLVGVPIPLSKVKSAARLFGLVLSAGDFSGKLYVEKDEDVTAVNSDLTALGFSPAHWVRYQDDQQKWFKCDDSNGKAICITLVPTANALLQTLGAHDAEKQHRYCLLPKWLLDAPTSIKREFLGALFGGNGAHITISCNEGKWEPTMSALTQHTDADHLESTVVYLKQVATLLGMLNICSSVSSEKHITAEKTGYAVHLHVDNTAENLVRFYEQVGYRYCFNKTSQSSAPVQWIKGSLFFIEQHRSKCQHAFELLHTGLGTKAAVSAEINMPHHNPSHMLNVKEIPTAPADEYITWIEFKDRYVHKESPRFVWVTIHSIEEAPAERLYDFNTVSQNHSFFANSIVSHN

SEQ ID NO: 126 - protein, 385 aa, B.subtilis M1918 (prophage)
  BsuP-M1918 RIR1 intein
CVTGETLLLTENGYEKAADLYKKQNNLKVVIDNRTKDFAVDSKGTTIVDAIPMQLTKKDAEIFKVKTKQGYEIRATEWHKFYVKRDGEIQKLQLNQLKTGDKLLVQSAEGAYGKIHEPDLAYIMGIIAGDGTITEKTAKIYLYDNKKVLEQKVTDAVHRIIHKHKVDRAYKHNTSLLPTFNMANPEKQDLLYMNSTVLFDILKKFGMNKERKTRVPEFIFQANKETQAAYLSGLFQTDGCVNANHKAKALTIELTSIHYESLQDVQKLLLNMGVYTTIYSNNKRSQELLPDGKGGSKLYNVKPTHKISIQDRNSRELFMSIVELKDYDVYKFNLLTETLQPKSRKPKHDFTAEIISIEEDGVEDVYDTTQEDYHSLIFNGIVTGN

SEQ ID NO: 127 - protein, 385 aa, B.subtilis strain 168 Sp beta c2 prophage
  BsuP-SPBc2 RIR1 intein
CVTGETLLLTENGYEKAADLYKKQNDLKVVIDNRTKDFAVGSKGTTIVDAIPMQLTKKDAEIFKVKTKQGYEIRATEWHKFYVKRDGEIQKLQLNQLKTGDKLLVQSAEGAYGKIHEPDLAYIMGIIAGDGTITEKTAKIYLYDNKKVLEQKVTDAVHRIIQKHKVDRAYKHNTSLLPTFNMANPEKQDLLYMNSTVLFDILKKFGMNKETKTRVPEFIFQANKETQAAYLSGLFQTDGCVNANHKAKALTIELTSIHYESLQDVQKLLLNMGVYTTIYSNNKRSQELLPDGKGGSKLYNVKPTHKISIQDRNSRELFMSIVEMKEYDVYKFNLLTETLQPKSRKPKHDFTAEIISIEEDGVEDVYDTTQEDYHSLIFNGIVTGN

SEQ ID NO: 128 - protein, 330 aa, Clostridium botulinum phage C-St
  CbP-C-St RNR intein
CFDGQQKTLTKSSHGVNYLSFKDLYDTKYKDKERRNFKVFHNGNWVEGKPIRLLRNDKKMYKITTVNNKEILVTEDHINVTDKGDKYTTQLTENDYIAFNTRPTNAIPEKDEKLTYEQGVLIGAYLGDGSKQRNEHKIQLSINEEKYNILRPLIEKALKQWNIQAQYRLYTPHNNFYPTAITSEDLLNIIEHWVKGDYSYNKRLNLEILHQSIEFRKGVLDGIYFTDGGNSNRIYTTSDSLKEDLEILIHSLGMVSIINTTDRTDEKVIIRGEEFNRNQKGLYKVINNTMFFKIKTIQQYISNDEYVYCFEMKNIEEPYFTLPNGIITHN

SEQ ID NO: 129 - protein, 330 aa, Clostridium botulinum phage D
  CbP-D RNR intein
CFDGQQKTLTKSSHGVNYLSFKDLYDTKYKDKERRNFKVFHNGNWVEGKPIRLLRNDKKMYKITTVNNKELLVTEDHINVTDKGDKYTTQLTENDYIAFNTRPTNAIPEKDEKLTYEQGVLIGAYLGDGSKQRNEHKIQLSINEEKYNILRPLIEKALKQWNIQAQYKLYTPHNNAYPTAIISEDLLNTIEHWVKGDYSYNKRLNLEILHQSIEFRKGVLDGIYFTDGGNSNRIYTTSDSLKEDLEILINSLGMVSIINTTDGTDEKMIIRSEEFNRNQKGLYKVINNTMFFKIKTIQQYISNDEYVYCFEMKNIEEPYFTLPNGVITHN

SEQ ID NO: 130 - protein, 146 aa, Coxiella burnetii
  Cbu DnaB intein
CVTGDTLICLADGRRVPIQDLVGHSPEVIAVDDKGRLVCAKSEVIWKVGERSVFEIKLASGRSIKATAEHRLLAFKGWRHVKDFKVGDRLAIAHQVPEPDRLLQHCQSDLFWDRIVSIEEKGSEEVYDLTVPKYASWLADGVVSHN

SEQ ID NO: 131 - protein, 370 aa, Chlorobium chlorochromatii CaD3
  Cch RIR1 intein
CVTADTLIATDRGLERIGNIVGESRGIKSIDGKLHWVENIFPTGTKPVYQLRTKSGYQLKLTGDHVVFTENRGDVKACELRKDDMVRLVGAPFGKETTGSTDIAQLIGLLTGDGCITTANEIAASGEQRRTAFLTVSKAEQEIAEWANQFINTLRPELGEHNKSGSVTETATTARVAVGSPRILKQFEAFAVLDKGSVHKLFTDKVFQLAQSEQAALLRGLFTADGTVANYSDKSQYIALDATSLELLQQVQLLLFNFGIKSKIYENRRVGELVSLLPDGKGGIKEYPVQQMHSLRISRSSRILFEQQIGFMAESKKYEALAELNRTVSTYRDSAYDAVASLTYSGEEAVFDLTEPETDHFIANGIGVHN

SEQ ID NO: 132 - protein, 456 aa, Chlamydomonas eugametos (chloroplast)
  Ceu ClpP intein
CLTSDHTVLTTRGWIPIADVTLDDKVAVLDNNTGEMSYQNPQKVHKYDYEGPMYEVKTAGVDLFVTPNHRMYVNTTNNTTNQNYNLVEASSIFGKKVRYKNDAIWNKTDYQFILPETATLTGHTNKISSTPAIQPEMNAWLTFFGLWIANGHTTKIAEKTAENNQQKQRYKVILTQVKEDVCDIIEQTLNKLGFNFIRSGKDYTIENKQLWSYLNPFDNGALNKYLPDWVWELSSQQCKILLNSLCLGNCLFTKNDDTLHYFSTSERFANDVSRLALHAGTTSTIQLEAAPSNLYDTIIGLPVEVNTTLWRVIINQSSFYSYSTDKSSALNLSNNVACYVNAQSALTLEQNSQKINKNTLVLTKNNVKSQTMHSQRAERVDTALLTQKELDNSLNHEILINKNPGTSQLECVVNPEVNNTSTNDRFVYYKGPVYCLTGPNNVFYVQRNGKAVWTGN

SEQ ID NO: 133 - protein, 415 aa, Candida glabrata
  Cgl VMA intein
CFAKGTQVLMADGSNQSIENIKIGDKVMGQDGKPRNVTALPRGYDDMYNVELDGETDLSYTCNSNHTLVLKTEQNVLLAGNTVSYFALGALIDETNGRAVEIVQEVQETFESNISASDFAANINREPISWTLEIRDIDYLSERVRMFTKQSVNPVLLETPTLAKQLESNESTATNLAYLLGTWIASKATTAGTISVPTTKADLLSKVKSALSSLSIDYSSESINSVSTYRRTQSIPLMENGKHVGNANITAEQEIEETMEVLSLNVTNHSSKLFHDLALSMINQDGSRSIPSAFTHEQLCVRESFVAGILDMQGCNIENGVEIDSSINGLAKLSRSLGLRCNKSSNLLKLSGNMSNISAQSTNNWTSTEDNSSAYKAQLMDFSVQKLPKDNYYGVTLDDDSDHQFLLSNLVLVHN

SEQ ID NO: 134 - protein, 339 aa, Chilo iridescent virus
  CIV RIR1 intein
CVAPETMILTEDGQFPIKDLEGKIIKVWNGNEFSSVTVVKTGTEKELLEVELSNGCTLSCTPEHKFIIVKSYTEAKKQKTDDNAIANAERVDAQDLKPRMKLIKFDLPTLFGNSEHDIKYPYTHGFFCGDGTYTKYGKPQLSLYGDKKELLTYLDVRTMTGLEDASGRLNTWLPLDLAPKFDVPINSSLECRMEWLAGYLDADGCVFRNGTNESIQVSCIHLDFLKRIQLLLIGMGVTSKITKLHDEKITTMPDGKGGQKPYSCKPIWRLFISSSGLYHLSEQGFETRRLKWEPRQPQRNAERFVEVLKVNKTGRVDDTYCFTEPINHAGVFNGILTGQ

SEQ ID NO: 135 - protein, 522 aa, Cryptococcus laurentii strain CBS139
  Cla PRP8 intein
CHAEGTELIKFDRSVVKVEDVVEGDRLLGPDGSPRLVSNLVSGCDRLYRFEFSRSGGEVESLVVTDNHIMMLKRANVVLSGSGDAGQLEVLDQISVREQFEIVQKTAAEVAAMSEAEREQYRVYRSEGFEHYEQPVDVHPYFLGLWLGDDSRSANAATNGEPEVRKFLTDYAGELDMHLAHHGDEKRDRRTVKAARLAAGWTLLPRTEGKAGAWIPPATAGYVAPTHSPAPNLRDADGHRSVSAPSQVDEKPEVSHDDEDMEISDTEEEQSDAIEEIEADDDDAAIVMEGPHGQLTPGGRRDEMQPAKARRRVRRLNRNQRYGDLADAEVEALLEDVVSGGQSDGQVVRSAQLLDKLQSLGVATSNEKEKPAQGSKHIPQVYLENTRDVRLRVLAGLLDSHGCLVSPENCYMFSQPETDGRLFWDAVHLARSLGFGVSTDRKTQMNPGSDVATPHLLALITGDLTQVPCLLRRQQAVQRYLPQQHTFRIKSVTLESKSTPWYGFAVDSDRQYLRHDWMVLHN

SEQ ID NO: 136 - protein, 171 aa, Filobasidiella neoformans (Cryptococcus neoformans) Serotype A, PHLS_8104
  Cne-A PRP8 (Fne-A PRP8) intein
CLQNGTRLLRADGSEVLVEDVQEGDQLLGPDGTSRTASKIVRGEERLYRIKTHEGLEDLVCTHNHILSMYKERFGREGAHSPSAGTSLTESHERVDVTVDDFVRLPQQEQQKYKLFRSTDFVRREQPSASKLATLLHINSIELEEEPTKWSGFVVDKDSLYLRYDYLVLHN

SEQ ID NO: 137 - protein, 172 aa, Cryptococcus neoformans (Filobasidiella neoformans), Serotype AD, CBS132).
  Cne-AD PRP8 (Fne-AD PRP8) intein
CLQNGTRLLRADGSEVLVEDVQEGDQLLGPDGTSRTASKIVRGEERLYRIKTHEGLEDLVCTHNHILSMYKERSGSERAHSPSADLSLTDSHERVDVTVDDFVRLPQQEQQKYQLFRSTASVRHERPSTSKLDTTLLRINSIELEDEPTKWSGFVVDKDSLYLRHDYLVLHN

SEQ ID NO: 138 - protein, 172 aa, Cryptococcus neoformans var. neoformans JEC21; identical to SEQ ID NO: 137
  Cne-JEC21 PRP8 intein

SEQ ID NO: 139 - protein, 333 aa, Clostridium thermocellum
  Cth TerA intein
QLALDTPIPTPDGWTTMGEIKAGDKVIDEKGRPCNVVAISEIDDTEQAYKINFRDGTSIVAGERHLWKVQVTNNGRREKLLTTGEMYQKQFKTKSKENRALFRIPIADAFILPENKLPIDPYLFGYWIGNGNAVKPEITVMRDDVDEVIKNIPYKLHNRYKQEGNSDILVYKELKSILVKNFREKRIPIEYLRASAQQRKRLLQGLIDSDGCVSTAKSQAIYVTILFELAKDVQDLLWSLGIKNTLKTAPSARYGIETGEICYLIKFTAFNDLEVSGLDRKLKRGRERNIKTRSHFHYIKSIEKTGKTKMRCIQVDSPSRLYLAGKSMIPTHN

SEQ ID NO: 140 - protein, 471 aa, Candida tropicalis (nucleus)
  Ctr VMA intein
CFTKGTQVMMADGADKSIESIEVGDKVMGKDGMPREVVGLPRGYDDMYKVRQLSSTRRNAKSEGLMDFTVSADHKLILKTKQDVKIATRKIGGNTYTGVTFYVLEKTKTGIELVKAKTKVFGHHIHGQNGAEEKAATFAAGIDSKEYIDWIIEARDYVQVDEIVKTSTTQMINPVHFESGKLGNWLHEHKQNKSLAPQLGYLLGTWAGIGNVKSSAFTMNSKDDVKLATRIMNYSSKLGMTCSSTESGELNVAENEEEFFNNLGAEKDEAGDFTFDEFTDAMDELTINVHGAAASKKNNLLWNALKSLGFRAKSTDIVKSIPQHIAVDDIVVRESLIAGLVDAAGNVETKSNGSIEAVVRTSFRHVARGLVKIAHSLGIESSINIKDTHIDAAGVRQEFACIVNLTGAPLAGVLSKCALARNQTPVVKFTRDPVLFNFDLIKSAKENYYGITLAEETDHQFLLSNMALVHN

SEQ ID NO: 141 - protein, 336 aa, Chlorella virus NY2A infects Chlorella NC64A, which infects Paramecium bursaria
  CV-NY2A RIR1 intein
CVAGDTKILTSSGYHPIKDMEGKQVRVWNGYEFSETIVHKTGVNQKLIMVSLDDGTELRCTPYHKFYIETGSRPADKSRVMEVRAGDLEKGDRIIRFELPTITVGETTMSDKEAYTKGFFSADGCVIKSKYGEDEYRISVKREDKIEALTKYVDVIKSHTNRFRTHFYVPDYVQNKFEVPINSMVNEKISWLAGFMDGDGCVIRYKDIENMQAVSINKSFLQDIRLMLQTIGIHSTINKFMPNRVMKMPDGRGGTDMYNGAESWRLQIDSEGVRKLFALGFTPRRLKMNGSRKRHHKTNKFTRVVSVTDHGDVEDTYCFNEPKRHMGVFNGVITGQ

SEQ ID NO: 142 - protein, 394 aa, Crocosphaera watsonii WH 8501 (Synechocystis sp. WH 8501)
  Cwa PEP intein
CFDGKTKILTNQGFMTLRQVYEQGYEGLSTLSLNTKTHKIEWKPILDTMKRQSEMIDISVSQTGRITDNTLRLTPDHKMVNLRGGKYTKTEIQDLLKQQEMLTVAQTIPSLGNNKHQEADLAYFLGGIITDGSIYTSSTRGEVQFIQKDVPEKQAFISKMNDLANSLYGKSFTAHIKPVSSSYIRGQKVTGQATAYRLHSKAIAYDVKERENNITQLLLENEAELSYHFLGGVIDGDGCYHKNRLHIYISEENLLQAVIIACLKMNTVPQVTKNRNIYHLQIVEKLEVILRYTQRVKGEVTPRTIQTRFFATRQLFENQETGQIKLRQDNNCLISDKQLREMGEFEELIDGDTRMQRVIQVGEKSDGDVYNITVAEHHNYVVFTAKYTPVVVCN

SEQ ID NO: 143 - protein, 347 aa, Crocosphaera watsonii WH 8501 (Synechocystis sp. WH 8501)
  Cwa RIR1 intein
CVAPETKILTDRGQIAIADVAGEKVNIWNGSEWSEVLVKKTGENQPLLKVHFSNGESLDCTYYHKFHVQENYKGKVKIVEAKDLQEGDKLIKYRLPLVESENDIDFPYAYTSGFFSGDGSHDGMGKPEIDLYGEKKELLPFVTVRNKYYGGSYGDKSWRIERDEVAVYDDVNQDRIVCKLPLDIPAKFTVPVNGYTIQSRLEWLAGLLDADGTVARNGDNESLQVASTHQQFLLDIRLMLQTLGVDSKVVKMDEMGYRSLPDGKGGYQDYFCQAKYRLLISSNGLFQLGELGLKTNRLQWNLREPQREASQFIRVEKVELTCRYDDTYCFSEPKRHLGMFNGILTGQ

SEQ ID NO: 144 - protein, 139 aa, Costelytra zealandica iridescent virus
  CZIV RIR1 intein
CVVGETLVLTQNGQFPIKYLVNQYVKVWNGEEWSEVVVKKTGFNQELVRVDFNNGTSIICTPYHNFLSLEDDSTIKNLKRICAQDLPCNFKVLYFYQNLDFVTTVKVTKITHLSQRADTYCFSEPLNNAGVFNGILTGQ

SEQ ID NO: 145 - protein, 464 aa, Dictyostelium discoideum strain AX4 (nucleus)
  Ddi RPC2 intein
CLHPDTIITMSNGQQKPIRQLKDGDSIITLDPITMEAHSTRIYSHFIKSSSQYGKQLLKITTITGKEIICTNDHRFLTSNGNWKQSKDLLLNDKLFLISSSNQLEFNNNNNENNNENNNDIIEILNENQLINQGVVPIKIIQELKSIELLPLLNNNEKLITISRIIGSIDKIGSNKQNEPIIQYQFNLISDFDQFLKDLQYLGFINPIYKLNEEQQQQQQQKIDHQQQQQQQVEQQQKSIIIDFIGSSFGYFIQSLLNEKNWIEKSNNQFVKKEFLSSFISNVNRIQFNIIEEINQQNNDSNFKILLNYKQQKQQQNEKEERAVVDHDNEIFNIKSLQILLNQFNVISSIDFEESNLIIINSSLKKFIDLINIKFNQKLNNQIIQIREYLNYINYNNNNNNNEEINIKKKDFGYFKKLKIKRNSFEIEIEKIEQLNYQDCPEISDFTTESDYHSMISNGFVSHN

SEQ ID NO: 146 - protein, 401 aa, Deinococcus geothermalis DSM11300
  Dge DnaB intein
CVTADTLIDVPGTGERITVEAFVRRQWPVVLSVSADGRVRESRVGAWIDSGVKPVRRVTTRTGRVVETTPHHPFLGVDGWTPLYDLKVGDRIAVPRAVPVFGQRDVLSAERVRLLAYLLAEGGLTQSGPRWTNADPELVQDFRACLAAEFPEVEMMADAWTGIDDRLSRRWQPGERQDRPNPLIGWLRELGVWGQPTDAKRFPAVVWTFTRPSLAAFLRVLLSCDGTLSTLAGKARIEFTVASEGLARDVHHALVRFGIVSKLWRKGERSWRVEITDPRSVADYQLQIGWLGEKALRTIPVSAETRSHVGHPPAGAWAHVRRAAGERTASGFNAHTGRSLPQSRAARYAAVLDDTQLTLLGSDALYWDDIVSIEDVGERQVYDLTVPGDANFIAADICLHN

SEQ ID NO: 147 - protein, 366 aa, Desulfitobacterium hafniense DCB-2
  Dha-DCB2 RIR1 intein
CVTGDTWVLTEEGAAQVRDLLGSQVKLALNGEYHETSKEGFFATGVKQVLTLKTQQGYELKVTADHLVRVASDMTRYKVTQEWKPAGELKPGDTIVLSNNRSIQWQGKGTKEEGYLLGLLLGDGTLKEEGAVISVWGEGEEAKSMMEAAEKAAFSLTHRQDFQGFQKEISERHEHRMRFAALRDLAQQYGILPGSKAITQELEKTGQDFYQGLLRGLYDTDGTVTGTQEKGVSVRLWQTDLAGLKVVQRMLQRLGIISTLYEERKPAGQKLMPDGQGGSKEYPVQAGHELVISQDNIEIFAEKVGFSNSKKAQLLAEKLNVYQRSLNRERFVDNIVACVPGDAEEVFDAQVPGINAFDANGIYVHN

SEQ ID NO: 148 - protein, 366 aa, Desulfitobacterium hafniense Y51; identical to SEQ ID NO: 147
  Dha-Y51 RIR1 intein

SEQ ID NO: 149 - protein, 607 aa, Debaryomyces hansenii CBS767
  Dhan GLT1 intein
CLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVAN

SEQ ID NO: 150 - protein, 394 aa, Debaryomyces hansenii CBS767
  Dhan VMA intein
CFAKGTEVLMADGSNKNIEEVQIGESVLGKDGEARNVVALPRGNETMYEINESTPEEEADLARIAFTCNAKHELVVNTKQDIAVEQNCVTYFALESVTDEANGREFSVVKSQTKTFEESSMAKEFASTISKNSIDWTIEARDVGHMSDDVRCATQQSWAPVLASKEVLAPVVQEAGFDATIAPYVSYLLGLWIGNGYSDRVQYLIDGKNTELINRVREYDEAIENNNQTSAKTVDFLWDVINSMSFKVEGKSGKAIPSFLRTESFEVREQFLAGLIDSDGIVTKNPLSASVRTNSSKVGEGVIAVSRSLGICTSVKAENESYIISMTRNSALESVLSKCALAEKTTSVPSHITRTGQNFDFSVKKIEAADYYGVTLPDNSDHQFMLANQAVVHN

SEQ ID NO: 151 - protein, 288 aa, Desulfovibrio vulgaris subsp. vulgaris DP4
  Dvul ParB intein
CQPAGTMVQKVIDPGAGSQSARIAEVPIETLRAGDFVVSYNPYESVIRRRGRQITRFGERQFDGLMHTISAAGRVTRATPEHRFTVRLNPSAADKQLVYLMRRGNWWRVGRVSLFSSRGFGLATRLADNKGEDAWIISVHDNAIEAQCAEQVLSCRYGIPTTHWEVDNWTKVPARQRSPGMIAGIYSCLNLGALSARATLLLRDHRLEREYPFITCGDQLMFSRRTTRLVRACNIHPGIMQIPMPSTGEDFDWITITGNDAAPFSGKVYSMDVDKDLHYVADGLVTHN

SEQ ID NO: 152 - protein, 605 aa, Emericella nidulans (anamorph: Aspergillus nidulans) FGSC A4
  Eni-FGSCA4 PRP8 intein
CLANGTQLLRYDGTKVNVEDVKEGDLLLGPDGGPRRAFNVVSGKDRLYRIKIDGDKEDLVVTANHILVLHRAKAMNTSVCFDRSKEQQGGAGEQLDISEVSAAERYDTVEMTAAEFAALHPQERSWYRAIRCPGFELPEQDVPVNPYFLGLWLGDESRNQSAIYSNHEEALREFLVSHAAELDMHLVYHGQSAYSTVCNKDRPTNKRIGPANQTQTVRPTIRQTRRTIRQQRLAAEHAAAEYTTQRETASLTPLLESPTSDKHGLLSSVETPGRLSDSVTTELPMSRSASAMRSIRTASGLSEFNDVTNVSASMPDIQNSGIKNQGRIAKVTRQQDSKGEVDFRQQYSQAIKDDLELLETDIEDDVASSDEIEDVCVVGSENELIGSEKQDQSGRRRQIHRLRTGHRGYGDLSDDEQEQLLDSVVERYAGDSRLNTLQQELSKMGILNPETGPINDKKRIPQVFMQNSRSVRLSVLAGLLDSDGWYIYPENMFGFAQSELCHKELFWDVVTLARSLGFGVWTKKRMMPDPTGKRMSPMLVAQISGDLAEIPCVLARKKAMPRLIPQSHSFAIKDISLESEATEWAGFRVDKDQLYLRHDYVVLHN

SEQ ID NO: 153 - protein, 366 aa, Ferroplasma acidarmanus, taxon:97393 and taxon 261390
  Fac-Fer1 RIR1 intein
CVTGDTKIFTSEGVKKARQLYEEGNPLNVKIDGRFGGEFKPSSNVIYTGFKDIYKIQTKEGFEIKVTGDHKIYSEKNGWTEALNLKENEKIRILNEGGSFGSSGTLEEGRVLGWLVGDGHINNGNNNDRAVLNFYSQDRVFADTFRKYVNDIVRPATNNREYNVGMVNIESRNCITIASERLKEFASEYDLIEEKLNVPDKVFAGSMELQRGFLQALFEADGTVYSGQKSRHSVRLGSISLNLLKQVQMLLLNFGIYSRIYQNRKKAGMRMLPDSNREMRLYATQDFHELNISAENLIKYADSIGFISERKNSKLNGAVNSYKKAPVKPSWLARVDKIEYVGREDVYDLVEPSTHSFVANGIVVHN

SEQ ID NO: 154 - protein, 356 aa, Ferroplasma acidarmanus
  Fac-Fer1 SufB (Fac Pps1) intein
CLPEDELISQGDKFVPINELLTDDSVVSNTGNQRKITRKYVHPYSGLMYKITPLSPGNAFRATSEHPVLSIKKEDVTSRIRDGHYEISTKKLMEAIPEYRRMDELSEGDFIVYVSPVETEDDASIDEDMLKILGLYTAEGSISFNKSLNLYQMSFSFGLSAKEEKIAYELYNIIKEKGERANIFKADKKYYTVSTYSKTLIDFCLNNAGKYADKKAFSEKIMKLPPEKQKLLIDYYLKGDGNVYIKKGKSKMIRAGTASKILALQLQEMLSRNNTFASIMIRKASDDVILGRNIKRKEQYIVEYTENIKFSRVRHKDNYYYVPIKKMEAEVYDDIVYNMEVETDDSYLVKGFAVHN

SEQ ID NO: 155 - protein, 408 aa, Frankia alni ACN14a
  Fal DnaB intein
ALALGTALPTPTGWTTMGRVAVGDMLIGADGRPTRVVAATDVMHGRPCYEVEFSDGSVIVADGQHQWITQTRAEPRRDGPVRSGSRTATLTRPVTTEEIARTLRCRTADRRCTHAVRVAGPFQLPAVDLPVDPYVLGSWLGDETAACASLTSADPEISEEIRRRGHEVVGSTSARHRPGLRRSAATERACTVCGRPFTAAMPGVRTCGQSCGGKLRFLAEPLSVRSCVDCGGRTTGFGPRCRSCHARAGTLQARLRTLGVLGDRHIPAGYLRASEQQRRDLLAGLLDADGTVASNGSTAQFATTNPRLAREVRELVLSLGCRATVTTTRTRGRSEETSTCFTVNFAPQDQVFRLARKAARLRPTGHPAAAVRYITDVRPIASVPVRCVEVDSPDHLYLAGETCIPTHN

SEQ ID NO: 156 - protein, 160 aa, Guillardia theta (plastid)
  Gth DnaB intein
CLSYATNQPYFLKSDNVNFSKLTSLKVSNHYILSATLELLIPFQYNRIYPIVSLIKRELQTGYKVVYELDFYISVIVSTVEHYVLTLNGWKRILELTVDDLVATLDIQYLIYNNTEVDLFSSNVIFSSVINLICMNRINVYDFWIPKTNNFFVNALLVHN

SEQ ID NO: 157 - protein, 258 aa, Gloeobacter violaceus, PCC 7421
  Gvi DnaB intein
CCAADTPIADPVTGALVTIEEIYRRGEAGKLVEVLTLLGDGRLARVEPSHFVDDGIKPVYRVRTGLGREVKTTLTHPYLTPTGWKPLAEIAAGARIAVPCRIPVFGSESLPPKEISLLCSRATRDNRIPDPVFRLPRAQLVAFLKQLCITADSARVSDRTVEFTSPSKSFCHQLQHLLLRLGVLSALREVSGIFYLDIKPAAETPIKPASLWSQDLAHHCDLHWDEIASIEYVGNEQVYDLTVPVTHNFVAADICLHN

SEQ ID NO: 158 - protein, 367 aa, Gloeobacter violaceus, PCC 7421
  Gvi RIR1-2 intein
CVTADTWVHTGDGPRQARDLIGVQHSTYVNGELFSTTSAGFFATGVKPVLRLRTKEGHQLRLTGNHQVLKLTAQTRHRQYTEWVPAEQLNPGDRVMLHDHRGLQPWDGPGDAETGWLLGTLVGDGCFVRDNNGTLCAKLSFWEASAPEMPGRAVTLATSRANVGRKLAGTINAQGVASVQSSGLARLAATFKIVPGCKRVTSRVEQGSFEFYRGFLRGLFDADGSVQGDQQKGVSVRLSQSDLPTLEAVQRMLLRLGIASDIYKRREAQVRMLPDSRRQSAPYPCKSQYELVIAKDNLQVFAQLVGFEHPAKAARLAKLVDTYSRTPNRERFSATVESLTPDGIEEVYDCTVPGPARFDANGLVVHN

SEQ ID NO: 159 - protein, 232 aa, Heterosigma akashiwo virus 01
  HaV01 Pol intein
SVTKETPLMLRTMETCGNHKHEVISIENVFTDNMRSIDMYSIIGEKEHVMLSRNEEIWTGENWSRIIRVIRHKTQKKIYGVLTENGYVEVTEDHSLISSDYELLKPKNCIVKETQLLQSFPDIVENSTIENNMIDIPKGQPCRLTVFGQVSAMIIYTYLKRKNYSITLNVCNVNSNKFYISFMERPRFKNTKKNIIKKIFFIRNTDNEEYVYDVETEDGIFHAGIGEIIVKN

SEQ ID NO: 160 - protein, 492 aa, Halorhodospira halophila SL1
  Hhal DnaB-1 intein
CLAYDAEIVQADGGVKTIEQIVRERRAHLATVGADWRLTWTEPCDYVDDGHKPVFEVTTRLGRRIETTLTHPFLTVHGWQRLEDLAEGDAIGVPRQLPVFGQEPIRDCEVRLLGHLIGDGGLTGSPPRLTSGQEAMTADFLEAVDAFGGVEAKPIRASRRTQSWVVVGAAQARAAARSSFASLVDALIRRSPLTGRAIARNLGVAPATLTYWRQGVNVPDAAMVGLLAGELGVDVGELRPEPVARRNDRNPLQAWLDRLGLAGKSAHEKTVPDCVFRLPREQLARFLNRLFSSDGWVTHLASGQGQIGYTTVSEALARQIQHLLLRFGVLAKLRHRSVRYQDGRRPAWQLDITHAESILTFAEQIGILGKEQRLASVAASVRGRRRQSHTDHIPCEIWQFIDRARGEWTWAELARRAGVASSNIHAYRRGMSRQRLAAFADALGSRELRQLASSDLYWDRIASIRPLGHKQVYDLTIPETHNFIANDVCVHN

SEQ ID NO: 161 - protein, 477 aa, Haloarcula marismortui ATCC 43049
  Hma CDC21 intein
CVHGDTRVTLADGHERPIREVVESNLDDPKPVDDGVWDTVDFDVPSLQSDGTVATQNATKVWKRKAPETLYRIRTATGRELDVTPSHPLFVQSDGRFQARKAEELESGTHVAVPRKVSTNACNELDVTFRQSQAHNRIDLDLPPQWTPELARLIGYIVAEGYVEQRPDNTGYVSITNNDREVLDDAKSVLETLNLNVTERSSHEGKTARELLCSAGEFVSFLASLDETLLQSSAERRVPQDIMRASDNVVTGFIRGYIEGEGHVSTSQREITVASMSKPLLEDVRTLLVTQGITAQLQPRNNGSYRLRISGQSFHDYAEQIGFITARKTEACRQFEGTHGNTNLDIVPNLGPELRRIREALGLTQSECGLPRSTYQHYERGRRNPSRDSLESVLDAFETRLAEMNNDTPISDTARSDGGGTGSLRQDLNGLAALVEGDIAWDRIESIEPIEHDEKWVYDLEIEGTHNYLTNGVVSHN

SEQ ID NO: 162 - protein, 180 aa, Haloarcula marismortui ATCC 43049
  Hma Pol-II intein
CFHPDTRLWYEDENDDWEYGTIEELVESRLDDPQEDDFGTLVQELDGDLTVSSLGENGPCRQPVDAVSKHPAPDHLVEVAVGDRTLRVTPDHTMLRAGPDGIEEVPASDLAAGDDLPAYDGGETTTMTARGEASTAATDGAAPTDTVEAVEYVESDVDHVYCLTVADTHRVAVEGTYVGQ

SEQ ID NO: 163 - protein, 409 aa, Haloarcula marismortui ATCC 43049
  Hma PolB intein
CFTPDTDVLTPEGVQNIRDLDIGDEVYSLDPETEEMEVKPVVETQSYPDYRGDLVDIETSKMDFRVTPNHRMLVRKNETNGITEDGYSFVEAGDLDDATNYELPHDWDGPDGDPLDTVDLTEYVDDYEVWVRPSVHGHTFAAEIGHYPDTVLKNDIGEEGYVFGPKEFEANREYIESVAERTYIHAESGRKWIPRTFDGDDFLELLAWYITEGNVYTSETKQFGEKTRGASTTVKIAQQAIADGGESDHAAIGDLLDRLGFDYYVDDRSYQFTSALLGDLLCNICGEDSFEKRIPEFVFDLSHRQKRRFLDTLIAGDGDRQKNSWRYTTSSDQLRDDVLRLCAHLGLTANYNRDSGSWRIYVTEDNKNTLRMHRSGSRSTADDGVYCVTVADNHTLMAGRNGKFQFVGQ

SEQ ID NO: 164 - protein, 538 aa, Haloarcula marismortui ATCC 43049
  Hma TopA intein
CLTADSDVLVRSENGDIERQTVDSLFSDGQVVLADGDTDIAVSKETPTVLSLDEATERVSEQESTLVSERPLRDDESVRTIETSRGAVTVTDDHPMYIRQDGEVTVRPASDIEAGTDLVAARRPPDTMVEPSDETVLSWETFAADCDKHSKLYGVDCGTELAAQRAARDESQTAFAERYGSYGSAVGKYERGEKDVPVWLLGELDIRPDRIHGLNYETSFENPFPLEWSPELAQVIGCLLGDGSIHRNDDENVVDVRYHNTDEALIERFARDIERLFDIEPTVTDRPGRESHHKRKYQVDVPSAVGRVLVCVLEAVTENGTPGLPDAVRPAFVGALFDDEGHISREGKAFISNTDHTLLTGVGEMLAEMGIETKLAPDQHKLHIRGRRNLEQFLDRIPIASDEKFYRGLDALDAYDVTTRKAELLEAIRQEPKTSAALAQTLGVTRGSVNKYLRELRESGHIEKQIEGSNRSLDENRTVQYVAADFEGSVYATLRGEPSSVTVEDVERREYDGPVYDLTVSENAPNFAVNGGAVVHNS

SEQ ID NO: 165 - protein, 182 aa, Halobacterium salinarum NRC-1
  Hsa-NRC1 CDC21 intein
CVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHN

SEQ ID NO: 166 - protein, 195 aa, Halobacterium salinarum NRC-1
  Hsa-NRC1 Pol-II intein
CFHPETNVWFRDESGEWHHDPIETLVEARLDPDTADEDDFGALVQALDGDVFVPSVTEDGEETLQRVEAVSKHPAPDHLLAVETKRGRELTVTPDHSMRRWTGDGIERVDARELTAGDALPAPTQVPGDGETATSELRSESLDGTHPQRRFGDGGSVRTDEVVSVEPVRSSVDHTYSLTVAETNTLVANGLFTGQ

SEQ ID NO: 167 - protein, 437 aa, Haloferax volcanii DS70
  Hvo PolB intein
SVTGDRPVVVRDPGGTVRILPIEDLFARGTTESEVLIAADGDVVASATPGKTRRALDGWDALSVNEDGEAEWQPIAQAIRHNTDKPVVNLQHKFGESTTTRDHSYVVPGEDGLTTVSPDDVAEPYRVSGVPDVEPVEQVDVYEVLRGYEREYEDGRSVGSDNSITKRKQIHADDEYVWFGHEHHRDVDSTVKVKRFVDIDSEDGAALIRLLGAYVPEGSASTGETATSKFGASLAESDREWLAQLQRDYSRLFENTTAGIITSDRRAERTVEYQTDTGGASVTYNDETLKLQMMNELAAVFFREFAGQTSRGKRIPSFVFHLPEEKQDLFLTLLVEGDGSREFPRYTEAYAQRNFDFETTSRELAAGLSMLLTQRGQKHSLKYRDSKDSYTIRTCSTYREGRDPVLTEADHDGYVYDLSVEENENFVDGVGGIVLHN

SEQ ID NO: 168 - protein, 215 aa, Haloquadratum walsbyi DSM 16790
  Hwa GyrB intein
CFSGDTEIALASGDSITFESLVDAYERGETHYCYTIGDDGRIRIEEIMNPRVTQEDAALLAVTLDNGEVIRCTPDHEFMLRDGNYCEAQNLTDGQSLMPLYRTTTEMTETTETTETTGTAEMVKQPFAQNNWESVSQLANRYNRRHTTTDHIVETQQIQSQQQSQIETVQISERADVHNHTVISVESLTETADVYDLEVPVTHNFALASGVFVHN

SEQ ID NO: 169 - protein, 521 aa, Haloquadratum walsbyi DSM 16790
  Hwa MCM-2 intein
CVTGETRIHTTDGFVPLKQLATQHHPKKVTTETAAAYERELYTVDPTTQSAEVTQSKSSHVWRMPEKHCRRIRTASGKQLEASVNTPVLTVDDAEIKWKPISAIESNDSVVIPQYNNVERSSVSITDIFEFTQEQLKLTEKSITILRTEIVSQYQNIAAAADALNIDVNSVEALITGQPVVSDVIDRVCDAISVSSEDITIHHVIGPTGTAIELPEVLNDDLLYLLGAAFACGNIMTGETCEERWIQFHAPEESIRSHIIDAAVATFGSESIQTDTEQANTVQVISATVTRLFETLGLEQITDAAPREIHPRLTAVSGADAFIRGLFDTGGRIDNKNTPQIAIGTASEPLAEQIQLLLETYGIGSCRDTGDQSHTGTSTTQGQYLTLTGSDAQAYRTTIGTRTDSGSSWDRQVSSSHADSEPSVRSTTTDTRKRTDMHEHEIISAGDVSTVSSVESDGGTPQMPRSNIEPQSIGYDYESSRVNEIQTETVVEAVNTGKKEVFDLTVPNTQNFIGGGIVTHN

SEQ ID NO: 170 - protein, 211 aa, Haloquadratum walsbyi DSM 16790
  Hwa MCM-3 intein
CVTGETLVSLADGRHVPIASLATDASKTGTIESKPDGVGRTIRGIDDLTVWTMTENKQLTGRPVTAIHQYDSPDTLWQITLSDGSEVTTTADHPFIIINRDGVHECPAKHLSENDEVYTPADGYTASTSDITPDSETSSDSLPDGGITQTRTNQYSSHRCDADLSDDELLDITTKTIKSIETVHPSDGTDVYDLTVSGTHNFVANGMIVHN

SEQ ID NO: 171 - protein, 572 aa, Haloquadratum walsbyi DSM 16790
  Hwa MCM-4 intein
SYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHN

SEQ ID NO: 172 - protein, 209 aa, Haloquadratum walsbyi DSM 16790
  Hwa MCM-1 intein
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHN

SEQ ID NO: 173 - protein, 529 aa, Haloquadratum walsbyi DSM 16790
  Hwa Pol-II-1 intein
CFHPETKIWFRDTDNEWHHETIQTFVEDRLDDPEIDAVGTLVQEVDDNTDREISVPSIDDNGNERLQSVTAVSKHRAPNHLVQIETISGREITITPDHEMHIFEQGNLVSKQASKITSGEYAVIPKRLQTISPSSHTPQHDLLREFLTRDELTADRLIIHTSDPVRLCNRVFPEEVTSCKDAVEIMQNTACHLDKNKETLIGWLGEGRIPVALLRGFVETDEALLMSIPDDVQIGLRGEKVRIDRHIGFTEELTSLLGYYAAAGIVHTQTNPISYESAQQEQSRITFYNIDTQTQTDLLNALNSVFEIEPIQYNLDGEILGVPGELIRRVFDTVFDVGTQPSHKRIPQALFDASESHITSYLRCFFSTHDSLTTDTRDISATTVSREFKEDIIAALRRLGITAEVTTQQSRSVPEVLPDWYAIDDITHHDADNSLNLTRSYVISIASSDAVTLQRDRQAQEQIKYDAQGLIANNNAIHQSRQVTDGGRKDYITEPITDIEYVDADIDYTYCLTVSETHSLIVNDLSQKQ

SEQ ID NO: 174 - protein, 544 aa, Haloquadratum walsbyi DSM 16790
  Hwa Pol-II-2 intein
SVAADSRLVAVSPDDKIVFTTIEDFWKKLNTPIERNGKFRKRTCVSEGWQTYAFDENHEASLRPIEKAIRYTADESEQLRRITTQLGRSLDITDEHSLFRYDDGIEEVAGDDLTAGDIIVAPRTLDVEVTQTTLDLSEYIHDNERCPSEQTGSGELNLASKSAISDSRNKETPGVTHNILPQRSKFTDEMTTLSPTAVGGLESEQNETLRVGESTGAIERYINVDDSFGWLLGQFIAQRSISTDALTMTVHTAAEKHAERIVATSDSVFGIKPTVNSIERGYEIVFPSVFDTIVSGLTAKEQSEPEQDVDHTHTDEIGIPECILHAPDDIVLSFLQGFILAENAQRKGNAASEASEMVSESETTVTLETPSVGVKDGLVFLCHRLGVITDISEKSGEEYSVHFEESRYTVSIATEGKTNPLDQILNGERPTMPEGVSVPVPDALLTIHESIANSPHIDQVIPDTVVQQETVSLETLQSLLTGLSTVDLPAQLEAKRDELTLLTEGDLSYLRVESVECVDYDGYLYDLQVGGEPVFTANWLYAHN

SEQ ID NO: 175 - protein, 434 aa, Haloquadratum walsbyi DSM 16790
  Hwa PolB-1 intein
CLPSDARIQMADGTETEIHAVEIGDNVIGTTDQRSVTATVTNKWKSEREIYEFSLADGTSLRSSGDHRIMISDSNTVDWKSGSDIEQGEYVLKPRQLPVDDPTIPIINNLLSSESANIIDTLEVDALDSTGRSMNIHSSNPRESIAHTATLSMADGGDQKQRNETTNNTLDLNRTVTKQDLYAIGRVLHNRITPRQDGITPVSQATLIDNSVLSSPSPANTQHQSDSILTEVISSLRGLVSPGAHAIDFSAIYEMPKSHIAQFLAGTLDGSETGETTSSNLTVTTESASIARWYAQLYRRLGIYAQYQADAVHIANNACDLQRLSDAILPRLRCSDTIDYVKTQIDTVCDSSLKHSRASSTGLSGDEANIRQFSDDGPQNKSYAAQPDSSDYDDDWNAYVFVEIEAITLNGTETTYDIETTTHNFVADDCLVHN

SEQ ID NO: 176 - protein, 431 aa, Haloquadratum walsbyi DSM 16790
  Hwa PolB-3 intein
SVTGDRPVVVRDPSDYIQIVPIKLLFEQATAPEQNMRLTADGAPSVNSELPKERRHLDQWEALSLSDTGETEWQPINQIIRHQTDKEILTLQHEYGESTTTRDHSYITADDGEYVETSPENVDEPLPIPNIASVKTIETIDIYQTLTTDTQAQIGNDTEPDKWLPSADCIHANDEYVWIGTTDKQQDRDDSTPAIPRYIDLTSDTGHALIRFLAVYLSDWSKSTITTTERGQCLHITGPQESALKTCAADADQLFTHITPSIAVDAESNTNTVDSGFRCHIPTTLATTLISAFAGHPAHTKQIPSIVYHLPAAEQSLFIRHLIQAESTPESDGVSGRPQKSDKPILLENEFITTNRELAAGVSMLLTQCGQSYTISKQDTKGAYTIHINNSSSSGCTPTLTETTHSGYVYDLSVATNQNFVDGLGGLVLHN

SEQ ID NO: 177 - protein, 408 aa, Haloquadratum walsbyi DSM 16790
  Hwa RIR1-1 intein
CLTADSTVMLKEKGMVSVSEVETGDQIAQRSDTGFQYKPVEETHAYENAETLTVTLTNGCSIRGTPNHRLMVDDEWTRIDEIQPDQEVHYTLGWLRETNQSPPKLHSQSHTTVNQTADSISPDSSEPIELSESENADTGNRHNSAVAVKQSRTQTQLISDEVVSRPEHTRRPDQLSEELAELLGLWIDTGLWHQSGVQFNVERENIAEYIDQLSQQLFDTPAAISDTDGTYTVDITDHKLKEWWKANFGGKPDGTQSSYVPQMIKEAPTNVIEAFLRGCFTAEGGLRKDMRPRLCTSSEDSIDDIAVLMMGLGYPVEKSVIRNADGEPYYSVMPATDDGLSAFLHDVGFIDERREIGLSNIESSDSRALNNTHKIEVESIVESPPATVYDITVADNHEYVTDGIISHN

SEQ ID NO: 178 - protein, 438 aa, Haloquadratum walsbyi DSM 16790
  Hwa RIR1-2 intein
CVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHN

SEQ ID NO: 179 - protein, 214 aa, Haloquadratum walsbyi DSM 16790
  Hwa rPol A'' intein
SIEADESIVIRRDGETELTEIGSFVDTILAADNQETRITDGHEIALAPNGLEVPSLDTDEQIRWKHIEAVSRHASPDEILLIELESGRSIRATKAHSFVTRRDGDVLPVAGETLVVGDVLPTVGSYDHASGSISVPLQSQSVAADGGTVEPNTNITANAERDSASITSAGIIGSATWERISSIETVAPEYEYVYDLSVSGLETFTTGEGVVTHN

SEQ ID NO: 180 - protein, 492 aa, Haloquadratum walsbyi DSM 16790
  Hwa Top6B intein
SLTPTQTLLIRRDGDVTFTSIGDFCDSYLPADGPASAPIPVDANIEVPSFDRATHEMTWQPVTNAIRHRTDERVYRISTACGRTLEITGNHSLFSLSSDNETIEVNAGELSPGDSILAPKQLPMASESVDTSTTVDEKTQSSTGAQTQRINILEHIKPDDLKESAATFRIHEADQASLSSGGNHKSPSASLASSQLASSEVIASAGGQQIQSSADQRQSKGHTPGGDHHNNECLLIKSVCENDKMSTVADYTLEIVTPDGESSRLPVSVSIDNVFITSLVRYIATASTSDISPVSDSSVDYTTEERHNTVDRSFSDTMRPLDSVIPLICEDDGEIELPSFVFESDPKRQQQLLTQLYRYPEASNGRNAGDDTVTYTTTSATLARQLTTLWNMNGVVATTNTQTETSQSDEIENESAQTTIYEVSVDRAEIETDIAGSDSDCQQGDGDLCLVSVSSVEEIDAPPYVYDISVPGASGHDENFVTANDGAICVKN

SEQ ID NO: 181 - protein, 339 aa, Invertebrate iridescent virus 6; identical to SEQ ID NO: 134
  IIV6 RIR1 intein

SEQ ID NO: 182 - protein, 502 aa, Kazachstania exigua, formerly Saccharomyces exiguus, strain CBS379
  Kex-CBS379 VMA intein
CFAKGTQVMMADGTDKSIEDIQLGENVMGKDGTPRTVISLPRGKETMYEVCHSSIKGTTNETLMNYVCSGNHKIVMQTPQQIGITEHAIDGKTYTSVSYFALRDSQDGYPIVKKLTKSFEHQQNGGKEQTLITVNNFVASLKSEPINWDVEAKHYESLGHYVKKCSYQLINPVFHQSGKLAQEIASLNYSKDKAPLLAWLIGFWVGNGAMRHSQFVIDSQDIELVNRIQEIATLLNLSATTACYYSGSVDDQDKLAKLNTATGEGFEDDLQSNPTAKELADMDILSESKTATLPTAFGVEKIDELIISLGEGRGNGNVFAQVIGSFGIDLADKDTLVSKIAHELAGDAFEVREQFVAGLVDATGYVRKDVYDHASEATVSIESKSTVLGLVKIARSLGIKIVVTSNDYQDPEDHDHGHDHGSCGHDEVATGYTAVMTGDALTNSMRFCAIGRNRVTAKQFMRQAIPFYFSLEKKSEDDYYGITVPDNTDKQYLLSSMALVHN

SEQ ID NO: 183 - protein, 410 aa, Kluyveromyces lactis IFO1267
  Kla-IFO1267 VMA intein
CFSKGTEVMMGDGKDELIENIQVGDEVMGRDGLPRQVVGLPRGHDDMYQVTEKSEDNETAKISFQCNSSHKLVLVTPQDIRLTESKEKVTVAFNRLADISVGNGTESRTVRLVERAEKSFANAESNQAIINAAEFVTTIDTTSIEWTLEARDMLLVDSSIREVTQQLINPVLLEKEHLAGVLKSNDFQSSLAPQFSYLLGAFVGSSGKDNSEYLQQLSAQFDKKIVAEKSIDVQSNGKTVGTASIVISQEPVQENKRRKVAQVSLVSKIVQESFSSGIPSFMMSENINVRESFLAGIVDSQNQKLDDTVALKTLSVKTHDGIARLARSLGIRVSGKKQNQEYTLTLSGDALKSVSNWTSTSNIEKVDVIHKAQPISFDLEKIESADYFGVTLAEESDHKFLLSNMTLVHN

SEQ ID NO: 184 - protein, 410 aa, Kluyveromyces lactis NRRL Y-1140; identical to SEQ ID NO: 183
  Kla-NRRLY1140 VMA intein

SEQ ID NO: 185 - protein, 428 aa, Kineococcus radiotolerans SRS30216
  Kra DnaB intein
CLTAGTRVLRADTGAETTMGELFALQARDVPVWSLDESLRYVRRHLTRVFPTGVKPVFRLRTASGKTVRATANHPFLTYDGWKPLGELSVADRLAVPRHVPAPERVASWTDDQVLLLGHLIGDGSFVKRQPLRYASVDEANLSAVTEAAANAFSIVAVRDEYAAARCTTLRLPAPYRLTHGRRNPLAAWLDELGLFGLRSYEKFVPQEVFHLPKRQIALFLRHLWATDGSVTLTRQSRGGRIYYASTSLQLIQDVSRLLLRFGISTRVRTTTPKGDHRPGYTLDVSGVDDQRRFLQEIGVHGARGATADRLLEVIRDVSANTNVDTVPRQVWDDVRRLLVEKEMTHREFAAAMGTSFGGSSLWKHAPSRERLGRVAQVLDSAELDVLAVNDVLWDEVVAIEPDGEEQVYDATVLGGHNFVADGIAVHN

SEQ ID NO: 186 - protein, 339 aa, Listonella pelagia phage phiHSIC
  LP-phiHSIC helicase intein
CHAYGHDIMMSDGTKKQVQDIAVGDKVMGPDGNPRKVIRLVKGQDEMFRVTPTKGESFVVNGGHILSLYQTPRRAGQTPGYTEISVNEYIRSSSTFKHRSKLQRFGFDLPGKNLPIPPYILGLLLGDGCITGVGQMSFTSQDHAAITEIERYLMSIGASNRLHFDSREAVGVCFRDYHRLEDHLTELGLYGRNSGDKFIPSEYLTSSNEDALEMIAGLLDTDGSLCPHGVYDYISKSRELSEGLVYLCRRVGLAAYISECEKSCQNGFKGTYYRVCVSGDLSKVPCRVSHKKCIFDRKQKKRVDVTGFKVEPIGVGDYYGFTVDGDHLYLDGDFVRHHN

SEQ ID NO: 187 - protein, 337 aa, Mycobacterium avium
  Mav DnaB intein
ALALDTPLPTPTGWTTMGDVAVGDELLGDDGRPTRVVAATDVMLGRPCYEVEFSDGTVIVADAAHQWLTETRVSRKSAQAAAVGYNRYKNQRTFAAVRTTAEIAETLRCPAQDRRLNHSVVNARALELPDREFLVPPYTLGAWLGDGTSAAAQITAADPEIIMRIEAEDSGAGVGTLQARLRTIGVLGNKHIPTEYLRGSEAQRRALLAGLLDTDGTVTVGGAVQFSVTNQRLARDVNELIVSLGYRCQTSTKRVQGRSETSSIAYTLTFSTADKVFALERKAIAHKERRAVTGTSRGGSRFIVDVRPIEPVAVRCVEVDNDSHMYLASRAMVPTHN

SEQ ID NO: 188 - protein, 337 aa, Mycobacterium avium 104; identical to SEQ ID NO: 187
  Mav-104 DnaB intein

SEQ ID NO: 189 - protein, 417 aa, Mycobacterium avium subsp. paratuberculosis str. k10
  Mav-PT DnaB intein
ALALDTPLPTPTGWTTMGDVAVGDELLGDDGRPTRVVAATDVMLGRPCYEVEFSDGTVIVADAAHQWLTETRASRKSAQAAAVGYNRHKNQRTFAAVRTTAEIAETLRCPTQDRRLNHSVVNARALELPDREFLVPPYTLGAWLGDGTSAAAQITAADPEIIMRIEADGVVAVPSGSAPYRYQLRLPPGAEQAPRRCVVCGKSFIPQTSQVRTCGRSCGGRARFMSDPVPSPTCVRCGGPSAGMRLCLKCHSTVGTLQARLRTIGVLGNKHIPTEYLRGSEAQRRALLAGLLDTDGTVTVGGAVQFSVTNQRLARDVNELIVSLGYRCQTSTKRVQGRSETSSIAYTLTFSTEDKVFALERKAIAHKERRAVTGTSRCGSRFIVDVRPIESVAVRCVEVDNDSHMYLASRAMVPTHN

SEQ ID NO: 190 - protein, 416 aa, Mycobacterium bovis subsp. bovis AF2122/97
  Mbo-AF2122 DnaB intein
CLTASTRILRADTGAEVAFGELMRSGERPMVWSLDERLRMVARPMINVFPSGRKEVFRLRLASGREVEATGSHPFMKFEGWTPLAQLKVGDRIAAPRRVPEPIDTQRMPESELISLARMIGDGSCLKNQPIRYEPVDEANLAAVTVSAAHSDGAAIRDDYLAARVPSLRPARQRLPRGRCTPIAAWLAGLGLFTKRSHEKCVPEAVFRAPNDQVALFLRHLWSAGGSVRWDPTNGQGRVYYGSTSRRLIDDVAQLLLRVGIFSWITHAPKLGGHDSWRLHIHGAKDQVRFLRHVGVHGAEAVAAQEMLRQLKGPVRNPNLDSAPKKVWAQVRNRLSAKQMMDIQLHEPTMWKHSPSRSRPHRAEARIEDRAIHELARGDAYWDTVVEITSIGDQHVFDGTVSGTHNFVANGISLHN

SEQ ID NO: 191 - protein, 359 aa, Mycobacterium bovis subsp. bovis AF2122/97
  Mbo Pps1 intein
CLPAGELITTADGDLRPIESIRVGDFVTGHDGRPHRVTAVQVRDLDGELFTFTPMSPANAFSVTAEHPLLAIPRDEVRVMRKERNGWKAEVNSTKLRSAEPRWIAAKDVAEGDFLIYPKPKPIPHRTVLPLEFARLAGYYLAEGHACLTNGCESLIFSFHSDEFEYVEDVRQACKSLYEKSGSVLIEEHKHSARVTVYTKAGYAAMRDNVGIGSSNKKLSDLLMRQDETFLRELVDAYVNGDGNVTRRNGAVWKRVHTTSRLWAFQLQSILARLGHYATVELRRPGGPGVIMGRNVVRKDIYQVQWTEGGRGPKQARDCGDYFAVPIKKRAVREAHEPVYNLDVENPDSYLAYGFAVHN

SEQ ID NO: 192 - protein, 440 aa, Mycobacterium bovis subsp. bovis AF2122/97
  Mbo RecA intein
CLAEGTRIFDPVTGTTHRIEDVVDGRKPIHVVAAAKDGTLHARPVVSWFDQGTRDVIGLRIAGGAIVWATPDHKVLTEYGWRAAGELRKGDRVAQPRRFDGFGDSAPIPADHARLLGYLIGDGRDGWVGGKTPINFINVQRALIDDVTRIAATLGCAAHPQGRISLAIAHRPGERNGVADLCQQAGIYGKLAWEKTIPNWFFEPDIAADIVGNLLFGLFESDGWVSREQTGALRVGYTTTSEQLAHQIHWLLLRFGVGSTVRDYDPTQKRPSIVNGRRIQSKRQVFEVRISGMDNVTAFAESVPMWGPRGAALIQAIPEATQGRRRGSQATYLAAEMTDAVLNYLDERGVTAQEAAAMIGVASGDPRGGMKQVLGASRLRRDRVQALADALDDKFLHDMLAEELRYSVIREVLPTRRARTFDLEVEELHTLVAEGVVVHN

SEQ ID NO: 193 - protein, 314 aa, Methylococcus capsulatus Bath, prophage MuMc02
  Mca MupF intein
CFPAETPVRAAARLGLKTWYAGKVVELQTRLGHRLTLTANHPVLTVRGWIAACQLQKGDQLIGDASGVNPRLAGVVNDEQPPARAEDLFQTLAAQGFRIVPMAPHDFHGDAGLRKPEIHIAGPDVHLMDEVQAAPGQFVGQQQLRRADACAIMDADRPDGPPPARMILADAVAPQNPADVAEAGAELAADGAFGDQPVAVQGQHPAFEMGVAVAGALPGGGALASNGGGVLFDGSPFDALGFRAPPQGDVAGTEQPAQGVTAASGLVRQLLEANAGLIALDEIVQIRQFDWAGHVYDFETETGLIMAGGVIVHN

SEQ ID NO: 194 - protein, 380 aa, Methylococcus capsulatus Bath
  Mca RIR1 intein
CVTADTWVMTASGARQVRDLIDRPFEAVVDGECHPTESRGFFFTGDKPVLRLSTAEGHTLRLTANHPVLRVSKMTRQLRETEWVKAGELRPHDKIVLHDHRALPSWDGAHTEAEGYLIGLLIGGGTLTRDKAILSIWDAAAPKVANGGGSVPAAGVAGVMRAAELAARTLPHRTDFNGWQTTMEGRGEYHMATGALHTLALELGLTPGDKRLTAPLETTSSAFHRGLLRGMFDADGSVQGSQRKGVSIRLPQTDLGNLQTVQRMLLRLGVASTIHQNRRPGGTKVLPDGEGGAKGHSCQAAHELIISGENVVRYAERIGFADSDKMDRLTALLQRYRHTRHAERFIATVQSLEDDGMEAVYDVTVADVHAFDANGLYVHN

SEQ ID NO: 195 - protein, 364 aa, Mycobacterium chitae
  Mch RecA intein
CFNYSTRVQLADGTTEKIGKIVNNKMDVEVLSYDPVADQVVPRKVVNWFNNGPAEQFLQFTVEKSGGNGRSQFAATPNHLIRTPAGWSEAGDLIAGDRVMASEPHRLSDQQFQVVLGSLMGDGNLSPNRRDRNGVRFRMGHGAKQGDYLQWKTDLLANIAHSAHENAKGARFVDFTPLPELAELQRAVYLGDGKKFLSEEYLKALTPLALAIWYMDDGGFTVRSKGLQQRTEGGSGRIEICVEAMSVGSRDRLRDYLRDTHGLDVRLRHAGAAGKAMLVFTTAASAKFQEIVAPYMAPSMEYKLLPRFRGQGTVAPQFVEPTERLVPARILDIHVKPHTRSMNRFDIEVEGNHNYFVDGVMVHN

SEQ ID NO: 196 - protein, 358 aa, Methanoculleus marisnigri JR1
  Memar MCM2 intein
CYDDETEVLTESGWKLFRDVTADDRVATLSADGRLEYAPPSNFVASEYDGEMYYVKSRQVDLAVTPNHRMYVNLNRRADEWEGFRLIRMDELPIHKRMRFKKNAAWTGERHETHWIPPVVKFANQNAEGKLTDPITVGMDDWLEFLGYFLSEGSVQRHHQTGVPYRVIISQTNPESAETIRQCLERLPFRFSYDGKNFSINAKQLAEHLAPFGKCHEKYVPDYAKSLPPEQIGILLDALMLGDGYINKTTGVSIYTTSSRRLADDVTELLLKKGLSGNVYLRREAGTVAANPRGGTSTATHDIFQVTFIRDGQNEPNINTNGKQHIEKRPYKGTIYCLEVPNHTLYVRRSGIPVWCGN

SEQ ID NO: 197 - protein, 165 aa, Methanoculleus marisnigri JR1
  Memar Pol-II intein
CFAGDTEITVSDGRRWMSLPIRQFVTENFDISKPGLDHVGTFYSDPRQPFYVRSIDSQGKTSLKRVTSVSVHRAPAHLVRFATRRGRVLTVTPDHAMLVWDTDYLRKIKALEVAVGDRVPVEEGGLVVADEVVSRETVQALDDRVYCLTVAENHTLVANGIFCGQ

SEQ ID NO: 198 - protein, 363 aa, Mycobacterium fallax
  Mfa RecA intein
CFSYGTRVQLADGSTEKIGKIVNQKMDVEVMSYDPVTDQIVPRKVVNWFNNGPAEQFLQFTVEKSGGNGRSQFAATPNHLIRTPAGWTEAGDLIAGDRVLAAERHLLSDQQFQVILGSLMGGGNLSPNLHDRNGVRFRMGHGARQADYLEWKTALLGNIGHSVRENDQGARFVDFTPLPELGELRRAVYLGDGKKFLSEDYLKALTPLALAVWYMDDGSFTVRSKGVQQRTQGGSGRIEICVEAMAEGTRERLRDYLRDTHGLDVRLRSAGSGKSMLTFSTEATAKFQELVAPHMAPSMEHKLLPRFRGLGTVEPRFVEPAQRLVPARVLDVQVKPRTRSMNRFDIEVEGNHNYFVDGVMVHN

SEQ ID NO: 199 - protein, 421 aa, Mycobacterium flavescens Fla0
  Mfl GyrA intein
CVTGDALVRLPFGQSVRLRDVVAGARSSSDNAIDLKVLNRHGDPVVADKLFHSGEHETYTVRTAEGYEVTGTANHPLLCLVDVGGVPTLLWKLTEEIRPGDHVVLQRTPPTEFGPADWQDAFEALHLGAFISEGFVSENRAGFNNLDREFFNAVLTAYDTIVGGPRYVSSRTIASDSLLHELDVHNLTALKKSRLGELVGQRSADKAVPEWLWKAPAVVKRVFLQALFEGDGSCSALPRNTIQVSYSTRSGRLAKDIQQMLLEFGVISRRYVHATGEHKVVLTSRAQAELFAAQIGFGGIKQAKLQGLLDALPQAAAGRDGDYVPGLAQFVRKHSGSRWVDKDWLNRHNIDRLSRWQRDGAEILGRIADPDVRAIAQELTDGRFYYARVASVTDSGVQPVYSLRVDTDDHSFITNGFVSHN

SEQ ID NO: 200 - protein, 364 aa, Mycobacterium flavescens, ATCC14474
  Mfl-ATCC14474 RecA intein
CFNYSTRVQLADRTTEKIGKIVTQKMDVEVLSYDPDTDRVVPRKVVNWFNNGPAEQFLQFTVEKSGGNGKSQFAATPNHLIRTPGGWTEAGDLIAGDRVMATEPHRLSDQQFQVVLGSLMGDGNLSPNRRDRNGVRFRMGHGAKQVDYLRWKTELLGNIKHSTRVNDKGATFVDFTPLPELAELQRAVYLGDGKKFLSEEYLKALTPLALAIWYMDDGAFTVRSKGLQERTAGGSGRIEICVEAMSEGTRVRLRDYLHDTHGLEVRLRQSGKAGKAVLVFSTASSAKFQELVAPYMAPSMEYKLLPRFRGQSTVSPQFVESTQRLVPARILDVHVKPHTRSMNRFDIEVEGNHNYFVDGVMVHN

SEQ ID NO: 201 - protein, 420 aa, Mycobacterium gastri
  Mga GyrA intein
CTTGDTLVRLPFGQSMRIADVVPGASPNSDNAVELKVLDRHGNPVVADHLFHSGDHQTYTVRTAEGYEVTGTANHPLLCLVDVGGVPTLLWKLIGEIHANDYVALQRTPPMELGPADWHGTMEALLLGAFISEGYVSETRTGFANLDRDYFTTAAGAYDGVVGGKRYVYQQTIGSGSPQHTLYTQKVTALKQSRLWQMVGVRSADKYVPEWMWHSPAAVKRTFLRALFEGGGSCSRLPRKTIQISYTTISKQLAMDVQQMLLEFGVISRRYLHAVGEYKVVITNRAQAELFATQIGFGGAKQTKLTKILASMPPCAGRDSDHVPGLALFIRRHCGSRWVDKEWLHKHNIDRLSRWRRDGAEILSHIADPDVRTIATELTDGRFYYARVASVTDAGVQPVYSLRVDTDDHAFLTNGFVSHN

SEQ ID NO: 202 - protein, 368 aa, Mycobacterium gastri
  Mga RecA intein
CGSWYTNVTLADGSTEKLGKIVNQKMDVEVLSYDFESGQIVPRRVTNWFNNGKAEEFLHFKVDRAGSGTGRGHASLAMTRNHLIRTPVGWREAEDINVGDRVMLAQPRLLSDQQWEIVLGSLMGDGCLSPPVRQDSESARLRIGHGAQQSAYFDWKVSLLANIPHSRTVNGKGAAFVDFSPLAELHELRSAVYLGDGKKFLSEEYLKGLTPLSLAIWYMDDGSFSLRSKGLQQRTQGGSGRIEICVEAMSEGSQVRLRDYLHDTHGLDVRLRKAGAAAKAVLVFSTAATAKFQQLVAPYMAPCMAYKLLPRFHGRSMVTPQFVEPIMELMPARVTEIESKTDYPIMSRFDIEVEGSHNYFADGVMVHN

SEQ ID NO: 203 - protein, 378 aa, Mycobacterium gastri
  Mga SufB (Mga Pps1) intein
CLAGDTLVWTANRGQVPIKEIEFGDRVFSYDESAERFVVAPVKASAQTDTRLTYEVKTTRRSVRATDNHPMLVLRDERKEGRQRARYARRWVTVGQIKPGDFIAVPRAVPNFGVAEQLPSVAGLTTPATSSADLMWLLGLYVGDGNLHLSTKTYRVQFAIPATDRELRAELTRVIKDLFGLRCIEADEYRVVVNSKALTEWIAALGFGGLSLTKRVPDWVYGLPVDQRLAFLGGWVDADGYVSPDKSGSILLTCANQALIGQARELAELAGLRAGGPWSFTQPYRHAPDRMQIAWRLGISGDFERLGCRNPKRTDRFGRRRYMHSSSGAHGTTIRAHCNDWLGFERVKAVEPYAVEPVYDIEVDGPHNFVAEGLVVHN

SEQ ID NO: 204 - protein, 165 aa, Methanospirillum hungateii JF-1
  Mhu Pol-II intein
CFHGDTLIEIYADGILEEIPIRRFVLEHLDLSQAGVDALGTFYADPVRPAHVRSVDTGGIPHLRKITSVSVHKAPANLIQFSTSRGKNLLVTPDHAMLVWDVSYLRKIRALEVKIGDAVPVWESGVVISDRIVSIDYVPCEDERVYCLTVDRDHNVVGNGIFTGQ

SEQ ID NO: 205 - protein, 499 aa, Methanococcus jannaschii (Methanocaldococcus jannaschii DSM 2661)
  Mja GF-6P intein
CLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHN

SEQ ID NO: 206 - protein, 501 aa, Methanococcus jannaschii (Methanocaldococcus jannaschii DSM 2661)
  Mja Helicase intein
CLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHN

SEQ ID NO: 207 - protein, 392 aa, Methanococcus jannaschii (Methanocaldococcus jannaschii DSM 2661)
  Mja Hyp-1 intein
CVPPDTLLILENGFKRIVDIKVGDKVLTHENRFKKVEKVYKRRYIGDIIKIKVRYFPEEIILTPEHPVYAIKTEKRCDGSHGICKFNCLTQYTNPSCKKRYRKYKREWIIAKDLKVGDVIVYPIPNRVRDIKYLSLDKYLSNIKREFCRSRIPEKIEVSEEFCRLVGYFLSEGYCFRDGIGFALGENEKKIIDDIEYLMKKIFNLKPKIRDDGRSEGIELKYYSRVLRDFFGDMFYCGDEKRAWNKALPNEFLYLPKNKQLQIFIGWWRGDKGVTTSEILMNQLRLISLRLGFIITFSKHVPKNPKIGDREVIKYHARWQGRVSILDEKIVDELKNEDIKLPKKDVRYGWIKGNYLYAPIIRIGREYYDGFVYNLEVEDDSSYVTVSGTLHN

SEQ ID NO: 208 - protein, 546 aa, Methanococcus jannaschii (Methanocaldococcus jannaschii DSM 2661)
  Mja IF2 intein
CLMPHEKVLTEYGEIKIEDLFKIGKEIVEKDELKEIRKLNIKVHTLNENGEIKIINAPYVWKLKHKGKMIKVKLKNWHSITTTPEHPFLTNNGWIKAENIKKGMYVAIPRKIYGNEDFEKFIEFINSKILTNELIVKVNEKDLKNVELPSTKIYKKQKNVFRSEDIIEHNLNIEKISFSPRIHRCGKPQHYIKLPKSLNEWKAIFYFAGVMFGDGCVDRIANNDEEVFNKLKSLNNLGIEVERIKRKSSYEIIFKNGKNALINLLKILFDYPSEKKSHNIKIPQILYIAPKELVAEFIKGYFDADGYVNLRQNRIEVISASKEFIEGLSILLLRFEITSKIYEIKKSYKETKKKYYQLNIVGKRNLKNFKNIGFSIKYKEENLNKIIEKSRKSEKYPINKDMKRLRILFGMTRNEVNVSYYAKYENGKEIPSYEIVKKFLNSLKPKNLDKKIKVLEGKERDVNYLKAFESDGLIENGRLTKLGREALNIWKNHEFGKENIDYMKSLIENIAFVEVEDVEIIDYDGYVYDLTTETHNFIANGIVVHN

SEQ ID NO: 209 - protein, 168 aa, Methanococcus jannaschii (Methanocaldococcus jannaschii DSM 2661)
  Mja Klba intein
ALAYDEPIYLSDGNIINIGEFVDKFFKKYKNSIKKEDNGFGWIDIGNENIYIKSFNKLSLIIEDKRILRVWRKKYSGKLIKITTKNRREITLTHDHPVYISKTGEVLEINAEMVKVGDYIYIPKNNTINLDEVIKVETVDYNGHIYDLTVEDNHTYIAGKNEGFAVSN

SEQ ID NO: 210 - protein, 412 aa, Methanococcus jannaschii (Methanocaldococcus jannaschii DSM 2661)
  Mja PEP intein
CIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFN

SEQ ID NO: 211 - protein, 369 aa, Methanococcus jannaschii (Methanocaldococcus jannaschii DSM 2661)
  Mja Pol-1 intein
CHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHN

SEQ ID NO: 212 - protein, 476 aa, Methanococcus jannaschii (Methanocaldococcus jannaschii DSM 2661)
  Mja Pol-2 intein
SILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHN

SEQ ID NO: 213 - protein, 494 aa, Methanococcus jannaschii (Methanocaldococcus jannaschii DSM 2661)
  Mja r-Gyr intein
CLTPDTYVVLGDGRIETIEDIVNAKERNVLSLDLDNLSIKIDTAIKFWKLRYNGNLSKITLSNNYELKATPDHCLLVLRDNQLKWIPAKDIKENDYIAMPFNYKVERKPISLLNLLKYLDITDVLIEFDENSTIFEKIAEYIRNNIKTSTKYKYLRNRRVPLKYLIEWNFDLDEIEKEAKYIYKSVAGTKKIPLFKLDERFWYFAGLVLGDGSIQDSKIRIAQTPLKDVKSILDETFPFLHNWISGNQVIISNPIIAEILEKLGMRNGKLNGIIFSLPESYINALIAGYFDTDGCFSLLYDKKAKKHNLRMVLTSKRRDVLEKIGIYLNSIGILNTLHKSREVYSLIISNKSLETFKEKIAKYLKIRKEAFINGYKTYKKEHEERFECDLLPVKEVFKKLTFEKGRKEILKDSKIHIENWYKEKTNNIPREKLKTVLRYANNSEHKEFLEKIVNGDISFVRVKKVENIPYDGYVYDLSIKHNQNFISNGVISHN

SEQ ID NO: 214 - protein, 548 aa, Methanococcus jannaschii (Methanocaldococcus jannaschii DSM 2661)
  Mja RFC-1 intein
CLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHN

SEQ ID NO: 215 - protein, 436 aa, Methanococcus jannaschii (Methanocaldococcus jannaschii DSM 2661)
  Mja RFC-2 intein
SVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHN

SEQ ID NO: 216 - protein, 543 aa, Methanococcus jannaschii (Methanocaldococcus jannaschii DSM 2661)
  Mja RFC-3 intein
CLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHN

SEQ ID NO: 217 - protein, 453 aa, Methanococcus jannaschii (Methanocaldococcus jannaschii DSM 2661)
  Mja RNR-1 intein
SLGRDELIFIKEGDKLKVCKIGEAIDEFMEKYKDKIIVDGDTEILYLDGIAEVYTISVNVKTGKAEFKRVYAISRHKPRGKVYKVIGKDGTSIIVTEDHSLFNYDENGNLVCVKPRQMKHIIRNFNNPYDVEYRIGDYIETNYQRTDSKYNSRQNDIPEKLKITKELCQFLGLFVAEGSYITNGISITTKDDDIAKFIERFVKEQINENIAVKRYEDSVRFVNKGFYRFLKEHINGKAINKNSPEFILKGDKEMKLAFLGGLISGDGYVSKDGRVQIYTTSEQLLGQLHLLLSDLGMIYSITKIKEEGEKIEIKRNEIVRNYKLYVIEIAKNCTEDLKPYVIPKYKKERIKPANYDQLPYDYRIIKEHLRKITDKKPYNDYAWKSNNRKLKLNTLEKIEQLNPHLREEINKFKLNIPFEIKEIKEIDYNGYVYDLSVEDNENFITATGILCHN

SEQ ID NO: 218 - protein, 533 aa, Methanococcus jannaschii (Methanocaldococcus jannaschii DSM 2661)
  Mja RNR-2 intein
SLPYDEKILIFENNEYKLVKIGEFVEKYLNRYKDRAITYGDNNIEVYIKDENIYAPSFDKDGKIVLKPITHAIRHRGKEIYEIELESGKKVRVTGDHSVFTINDNLDVVEVKASDLKVGDFIITPKIIPSISKDKIYLSEIVKNKDKYYVKIKDHIKFIEEHEEILKESYKEYKTKWKDLKPVLKKKNAFRLDLIEDLVDKEKIEKISYGHANYINNKIKLDEKFGYLIGAFLSEGHWNDKCVEISSTNKEFIENLVEIIEEILGKDAYYITVKGDKRRYKDLYVIGLNKTVAMIFESLGLNKLSSNKEIPSILLSNETFLKGLIKGYIDGDGSIYVDESKRDYSIRLYTTSETLRDTLCLALKILGINYRLSIDKKSKVNENWRDCYVIKITGKENIEKLLDVEIKNNGGKDVIPKIAEKFKEIINQYSQREWKERFGIDVNNLHIWEDLKKGYMSRYRAKKVLNIMKNVKEIEEKYGRLLDKIGQLIDNDLLFERIKSIRVLDEIPEYVYDISVEGTENFIGGEGFICLHN

SEQ ID NO: 219 - protein, 452 aa, Methanococcus jannaschii (Methanocaldococcus jannaschii DSM 2661)
  Mja rPol A' intein
CVDGDTTVLLDGKLIKIKDLEDKWKDVKVLTSDDLNPKLTSLSKYWKLNADEYGKKIYKIKTELGREIIATEDHPFYTTNGRKRCGELKVGDEVIIYPNDFPMFEDDNRVIVDEEKIKKVINNIGGTYKNKIINELKDRKLIPLTYNDQKASILARIVGHVMGDGSLIINNKNSRVVFRGDIEDLKTIKEDLKELGYDGEEIKLHEGETEITDYNGKKRIIKGKGYSFEVRKKSLCILLKALGCVGGDKTKKMYGIPNWIKTAPKYIKKEFLSAYFGSELTTPKIRNHGTSFKELSFKIAKIEEIFDEDRFIKDIKEMLKEFGIELKVRVEEGNLRKDGYKTKVYVASIYNHKEFFGRIGYTYANKKETLARYAYEYLLTKEKYLKDRNIKKLENNTKFITFDKFIKEKCLKNGFVKEKIVSIEETKVDYVYDITTISETHNFIANGFLTGN

SEQ ID NO: 220 - protein, 488 aa, Methanococcus jannaschii (Methanocaldococcus jannaschii DSM 2661)
  Mja RtcB (Mja Hyp-2) intein
CLTSNSKILTDDGYYIKLEKLKEKLDLHIKIYNTEEGEKSSNILFVSERYADEKIIRIKTESGRVLEGSKDHPVLTLNGYVPMGMLKEGDDVIVYPYEGVEYEEPSDEIILDEDDFAEYDKQIIKYLKDRGLLPLRMDNKNIGIIARLLGFAFGDGSIVKENGDRERLYVAFYGKRETLIKIREDLEKLGIKASRIYSRKREVEIRNAYGDEYTSLCEDNSIKITSKAFALFMHKLGMPIGKKTEQIYKIPEWIKKAPKWVKRNFLAGLFGADGSRAVFKNYTPLPINLTMSKSEELKENILEFLNEIKLLLAEFDIESMIYEIKSLDGRVSYRLAIVGEESIKNFLGRINYEYSGEKKVIGLLAYEYLRRKDIAKEIRKKCIKRAKELYKKGVTVSEMLKMDEFRNEFISKRLIERAVYENLDEDDVRISTKFPKFEEFIEKYGVIGGFVIDKIKEIEEISYDSKLYDVGIVSKEHNFIANSIVVHN

SEQ ID NO: 221 - protein, 335 aa, Methanococcus jannaschii (Methanocaldococcus jannaschii DSM 2661)
  Mja TFIIB intein
SVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKELPNIEEDIEIDKKFSKILGYIIAEGYYDDKKIVLSYDYNEKEFINETIDYFKSLNSDITIYSKDLNIQIEVKNKKIINLLKKLRVKNKRIPSIIFKSPYEIKKSFIDGIFNGKDAKVFVSKELAEDVIFLLLQIKENATINKKSINDIEVYEVRRITNIYTNRKLEKLINSDFIFLKIKEINKVEPTSGYAYDLTVPNAENFVAGFGGFVLHN

SEQ ID NO: 222 - protein, 454 aa, Methanococcus jannaschii (Methanocaldococcus jannaschii DSM 2661)
  Mja UDP GD intein
CFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHN

SEQ ID NO: 223 - protein, 394 aa, Methanopyrus kandleri AV19
  Mka CDC48 intein
SIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHN

SEQ ID NO: 224 - protein, 305 aa, Methanopyrus kandleri AV19
  Mka RFC intein
SVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHN

SEQ ID NO: 225 - protein, 482 aa, Methanopyrus kandleri AV19
  Mka RtcB intein
CLAPGTKILTEHGCWVKVEDLPKMLTDQKLKVYDVDEGREDDSEIKFVMERGIEEDERAVVLVTESGLTIEGSEDHPVLTPEGYVELGEIEEGDLVVVYPFEGVEYEEKEGTILDESDFEDVDPQVLRYLEERDLIPLRWSDPKVGTLARILGFAMGDGHLGEQAGRLTLSFYGDERTLRELKRDLESLGVKANLHVRKRRYEIETASGRYEGEATSVELRVASRSFALLMEKLGMPRGRKVETPYKVPDWIKEAPLWVKRNFLAGLFAADGSVVKFKRYTPLPINLTQAKVEELEENLREFMNDVAKLLREFGIETTLYEVKSKKNVVYKLAIVGEENIKRFLGKVGYEYDPEKKVEGLAAYAYLKLKERVKKDRKEAAETAAEVYEETGSITKAHEAVADVVNRRFVERVVYDGGISSVRVPEDFPTFERFKEERVLAGGFVIEEVVEVKGVEPEYDRFYDIGVCHGAHNFIADGVVVHN

SEQ ID NO: 226 - protein, 517 aa, Methanopyrus kandleri AV19
  Mka VatB intein
CFAPGTRVITASGDVVEIDEIVERAAETAVDGGLREGSTEVTVGVTNVRTLAAWDGDLTSNDVVAVEKIEAPSRAVRVRTRSGAELVVSEDHKFLVDTEDGPRMVEASELKSGDELYSVRELRVSEKVPTYLELLLEAEDKFYVHPTEEFEEAVAERYGSLAEACREKELPYRAREAKERRYYELSEFARLATAVIESVDEATEYIDYVTAGGRKRVKFSSPRPGKEVMYVAGLIASDGSVDTERGFVMFSNTERELLSAFEEIVTEEFGVDASKTENQNGVTMLRVNSRVLARVFERLADPKTVLKMPRELVAAYLAGYVDGDGHLKDGKIVITTADRERAGDLQLLLKRLGVPSVLRERDGAYDVVVTGHDAAELAEELPLRHPKKAEAAASMSSGRRSSRFDRVSRRFGRLLREVRRKYGVRASDLGSSSTISQIESGERRATRRLALEIVERLEEVVGDVEEVRELRELAEGNYVLDEVVEVETVEYEHEYLYDVTVVPDHTLVVENGIITSN

SEQ ID NO: 227 - protein, 420 aa, Mycobacterium kansasii
  Mkas GyrA intein
CVTGDALVRLPFGQSMRIADVVPGARPNSDNAVELKVLDRHGNPVAADRLFHSGDHQTYMVRTAEGYEVTGTANHPLLCLVDVGGVPTLLWKLIEEIHPDDYVALQRTPPMELGPADWHDTMEALLLGAFISEGCVSETRAGFANLDRDYFTMVARAYDAVVGDKRDVYQQTIASGSLQHTLYTQNVTALKQSRLWQILGMRSADTYVPEWMWHSPAAVKRVFLQALFEGDGSCSRRPHNTIQISYNTVSKQLAMDVQQMLLEFGVISRRYLHAAGEYKVVITDRAQAELFPKQIGFGGAKQTELSKILAAMPPCAGRDSDHVPGLARFIRRHCDSRWVDKEWLHKHNIDHLSRWRRDGAEILSHIADPDVRTIATDLTDGRFYYARVASVTDTGVQPVYSLRVDTDDHAFLTNGFVSHN

SEQ ID NO: 228 - protein, 145 aa, Mycobacterium leprae, strain TN
  Mle DnaB intein
ALALDTPLPTPTGWTAMGDVAVGDELLAVDEAPTRVVAATEVMLGRPCYEIEFSDGTVIVADAQHQWPTSYGIRTSAQLRCGLDIIAAAGSTPRHAGRLTTAAFMAPVLCIDSVRRVRSVPVRCVEVDNAAHLYLAGRGMVPTHN

SEQ ID NO: 229 - protein, 365 aa, Mycobacterium leprae, strain TN
  Mle RecA intein
CMNYSTRVTLADGSTEKIGKIVNNKMDVRVLSYDPVTDRIVPRKVVNWFNNGPAEQFLQFTVEKSGSNGKSQFAATPNHLIRTPGGWTEAGNLIAGDRVLAVEPHMLSDQQFQVVLGSLMGDGNLSPNLCDRNGVRFRLLGYGCKQVEYLQWKKALMGNIRHTVRENSMGASFIDFTPLPELVELQRAVYLGDGKKFLSEEYLKALTPLVLAIWYMDDGSFTVGSKRVQERTAGGSGRIEICVDAMTEGTRVRLRDYLCDTHGLDVRLREVGSAGKAVLVFSTAATAKFQSLIAPYVAPSMEYKLLPQFRGRGSVTPQFVEPTQQLVPARVLDVHVKLSTRSMNRFDIEVEGNHNYFVDGVMVHN

SEQ ID NO: 230 - protein, 325 aa, Bacteriophage Aaphi23
  MP-Aaphi23 MupF intein
CFPGQSELKGLPRPEKLYRRWYSGKLTELVTDNGTVLLATPNHPILTSNGIKSIDSVNVGDYLACEIKQTFDTVKLNGKNLIPTIEQVFNSLLLNGVRTSISSSKSGKFHGDFSDSEIEIISIDSFLIDVLNALFIKKLPELGFTNADMVICKALFSTDSHFDLLKCASGSTGSSFMSRFNLLCSLLVAHLTPLELFCLGLGANIGIIGKQIPANNISRDVEMFSNHIFACAALIHGKDFINWQRDRIMSLVAPNFGHRYTDSFETLSKRLLVTTNNSANFGNAQSLGIEFRRVVNKVVTQASCHIYNLQTVSGYYNINSVFVSN

SEQ ID NO: 231 - protein, 341 aa, Mycobacteriophage Bethlehem
  MP-Be DnaB intein
PLALNTEVPTPSGWTTVGDLSVGDYVLGSDGQPHRVQRETPVLEGLATYVVRFDDGTEITASASHGWTTQRLTGHGDSYETVTVTTEELAQTVTNSKGRKRHRIPVVGMELPNQELPLDPWFLGLWLGDGATSDSTVSFDYRLRDEYATLLKPLVQEFQTVVWDNPVPGTNVGTFRIKNNDRTQDDKSIRSLLRKAGVLGNKHIPAAYMQAGTDQRFELLRGLIDSDGGIDSVGRAYFVNANRNLVYQFQELVVGLGFRCTVREHGGDGALRAEFNPGNAVRVSNLAYKFERQRPYSSRNRSQHRWVESVTPVESVPVKCIGIDTEDHLFQVSRSRILTHN

SEQ ID NO: 232 - protein, 317 aa, Mycobacteriophage Bethlehem
  MP-Be gp51 intein
CSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDYPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGN

SEQ ID NO: 233 - protein, 331 aa, Mycobacteriophage Catera
  MP-Catera gp206 intein
SLACSTPILTTNGWSTMGALQDGDEVYAPDGQPTKVIKAHPINLNRPCFKVRFRDGQEVVTDAEHLWQVNDRNNGGRDRVMTTQEIADAPWGGRYRFRVPVTEPLQTPEADLPVDPWLLGAWLGDGDASMVSICSGSQDLDYLISRVEGLGLSHRVNRYGSRAASVYVHGMRAVFSELGLLKNKHIPDRYLTASVAQRRQLLAGLMDSDGTVSDRQVTISMKNERLMRQVLQLVRSLGYRAGFGSRMARLNGRDCGLVYVVRFHTGWGESPFDMPRKRDGWEQATKTSVQNLRLNAIVAVEPVETVPVRCITVAHESSLYVAGEGFVPTHN

SEQ ID NO: 234 - protein, 331 aa, Mycobacteriophage CJW1
  MP-Mcjw1 DnaB intein
ALDVETPILTGNGWKKMGDIQVGDYVHAADGTLARVSYVSERHWRDCFSVQFADGAELVASDHHLWAVNDRLKGERVIDTAELYRTQTYGARGDRRYTVTVPEALDRDEAPLPLDPYILGAWLGDGTATRAEFTSEDPEIFAAIEAAGYPLSYDYASGNARTRGAKGLVAVLRKMGVLGAKHVPQDYLIGSRAQRLALLQGLMDTDGSVITGPNTPRVEFCNTNRDLAEAALFLARSLGWKATLKESRARLNGKDCGPRFRVSWTAYSDMSPFRLQRKSEKLAAAPARATRARTNTITSVTPVPTVETVCIQIDHPSHVFLAGKSLTPTHN

SEQ ID NO: 235 - protein, 340 aa, Mycobacteriophage Omega
  MP-Omega DnaB intein
ALAIDTPILSERGWTTMGDLVDGDRVYGPDGQLTNVIAHPIRYERPCYRLTFDDGQTIVADEDHLWTVYDAVKREHRTLTVRELVDGGVFTTRRNAGRADSNIYRYRVPVTEPLAGVEADLPVDPYLLGYWLGDGDTNAGRFTVGEEDLEAFKLTLESLGYEYSDSVDPRTGAHTICAYGFIQGLREAGVVGNKHIPETYLTASMEQRRALLAGIMDSDGGVTGHQISVTMKNEALMRQVLMLARSLGYKSFFTSHLSMLNGEHKARVYRVKFANRQELNPFRLPRKAAKVLPPLGRVTRAQYNAIVSIEPVESVPTRCITVDNDSRLYVVGHGFVPTHN

SEQ ID NO: 236 - protein, 317 aa, Mycobacteriophage U2
  MP-U2 gp50 intein
CSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDCPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGN

SEQ ID NO: 237 - protein, 364 aa, Mycobacterium shimodei
  Msh RecA intein
CMNYSTRVTLADGSTEKIGKIVNNKMDVKVLSYDPDSDRIVPRKIVNWFNNGPAEQFLQFTVEKSGGNGKSQFAATPNHLIRTPAGWTEAGDLNTGDRVLAAEPHLLSDQQFQVVLGSLMGDGNLSPNRRDRNGVRFRLGHGAKQAEYLQWKTALMGNIGHTVRENAKGASFVDFTPLPELAELQRAVYMGDGKKFFSEEYLKALTPLALAIWYMDDGSFTLRSRGLQERTAGGSGRIAICVEAMTEGTRVRLRDYLRDTHGLDVRLRSAGSAGKTVLVFSMAATAKFQELVAPYMAPSMEYKLLPRFRGRSTVRPQFVEPTQRLVPARILDVHVKPHTRSMNRFDIEVEGNHNYFVDGVMVHN

SEQ ID NO: 238 - protein, 322 aa, Mycobacterium species KMS
  Msp-KMS DnaB intein
ALALDTPLPTPDGWTTMGEVEVGDELIGADGRPTRVVAATDVMVGRPCYEVEFSDGTVIVADAQHQWLTDTRASGRSARVAAAVRTTEQIAATLRCPTADRRLNHSVANAAPLQAPTRELLVPPYTLGAWLGDGTSAAAQITTADPELVMRIEAEGVEFGTLQGRLRTIGVLGDKHIPIEYLRASESQRRALLAGLLDTDGTVAVGGGVQFSVTNKRLAADVAELVVSLGYRCRSTTKHVKGRSADSSVAYTLNFSTDDDVFGLARKAILHKERRGASTTVRSDSRFIVDVRPVRSVPVRCVEVSNDSHMYLAGRSMVPTHN

SEQ ID NO: 239 - protein, 421 aa, Mycobacterium species KMS
  Msp-KMS GyrA intein
CVTGDALVRLPLGQSVRIDGVVPGAKPNSDNPIDLKVVDRHGDPVAADRLFHSGEHQTYKVTTTEGYTVTGTENHPLLCLVDVGGVPTLLWKLVEEIRPGDTVVLQRSQPMEFGPADWQETLEALLAGAFISEGFISEKRAGFNNLDRDFFNMVVAAYDAVVGGRRYVSSRTIASGSLLHELDIHNLESLRRSRLGVAVGQRSADKFVPEWIWQSPAAVKRVFLQALFEGDGSCSRLPRNTIQVSYSTRSERLAADVQQMLLEFGIVSRRYRHAVGEYKVALTNRAQAELFARQIGFGGAKQVKLLEILSALPEEAAGLDRDFVPGLARFIRQHSGGRWADKEWLRKHNVDRISRWQRNGAEILGRIADPEVRAVATDLTDGRFYYATVASVADAGVQPVYSLRVDTEDHAFITNGFVSHN

SEQ ID NO: 240 - protein, 322 aa, Mycobacterium species MCS; identical to SEQ ID NO: 238
  Msp-MCS DnaB intein

SEQ ID NO: 241 - protein, 421 aa, Mycobacterium species MCS; identical to SEQ ID NO: 239
  Msp-MCS GyrA intein

SEQ ID NO: 242 - protein, 134 aa, Methanothermobacter thermautotrophicus (Methanobacterium thermoautotrophicum); identical to SEQ ID NO: 2
  Mth RIR1 intein

SEQ ID NO: 243 - protein, 365 aa, Mycobacterium thermoresistibile
  Mthe RecA intein
CFDYSTRAQLADGTTEKIGKIVDNKMDVEVLSYDPDTDRIVPRKVVNWFNNGPAEQLLQFTVEKSGGNGRARFAATPNHLIRTPGGWTEAGDLIAGDRVLAAEPHRLSDQQFQIVLGSLMGDGTLSPDPRGRNGVRFRMGHGADRVDYLEWKTALLGNIKHSTGENAEGARFVDFTPLPELAELRRAVYLGDDGRKFISEEYLKALTPLALAIWYMDDGSLTVRSEGLQQGTAGGSGRIEICVEAMTEGSRIRLRDHLRDTHGLDVRLRQAGAGGKAVLVFSTAATAEFQELVAPYMAPSMEYKLLPRFRGQSRVVPQFVEPTQRLVPARILDVHVEPHTRSMNRYDIEVEGNHNYFVDGVMVHN

SEQ ID NO: 244 - protein, 359 aa, Mycobacterium tuberculosis strains H37Rv & CDC1551; identical to SEQ ID NO: 191
  Mtu SufB (Mtu Pps1) intein

SEQ ID NO: 245 - protein, 416 aa, Mycobacterium tuberculosis, CDC1551; identical to SEQ ID NO: 190
  Mtu-CDC1551 DnaB intein

SEQ ID NO: 246 - protein, 416 aa, Mycobacterium tuberculosis H37Rv
  Mtu-H37Rv DnaB intein
CLTASTRILRADTGAEVAFGELMRSGERPMVWSLDERLRMVARPMINVFPSGRKEVFRLRLASGREVEATGSHPFMKFEGWTPLAQLKVGDRIAAPRRVPEPIDTQRMPESELISLARMIGDGSCLKNQPIRYEPVDEANLAAVTVSAAHSDRAAIRDDYLAARVPSLRPARQRLPRGRCTPIAAWLAGLGLFTKRSHEKCVPEAVFRAPNDQVALFLRHLWSAGGSVRWDPTNGQGRVYYGSTSRRLIDDVAQLLLRVGIFSWITHAPKLGGHDSWRLHIHGAKDQVRFLRHVGVHGAEAVAAQEMLRQLKGPVRNPNLDSAPKKVWAQVRNRLSAKQMMDIQLHEPTMWKHSPSRSRPHRAEARIEDRAIHELARGDAYWDTVVEITSIGDQHVFDGTVSGTHNFVANGISLHN

SEQ ID NO: 247 - protein, 440 aa, Mycobacterium tuberculosis H37Rv,Also CDC1551; identical to SEQ ID NO: 192
  Mtu-H37Rv RecA intein

SEQ ID NO: 248 - protein, 440 aa, Mycobacterium tuberculosis So93/sub_species="Canetti"
  Mtu-So93 RecA intein
CLAEGTRIFDPVTGTTHRIEDVVDGRKPIHVVAAAKDGTLHARPVVSWFDQGTQDVIGLRIAGGAIVWATPDHKVLTEYGWRAAGELRKGDRVAQPRRFDGFGDSAPIPADHARLLGYLIGDGRDGWVGGKTPINFINVQRALIDDVTRIAATLGCAAHPQGRISLAIAHRPGERNGVLDLCRRAGVHGKLAWEKTIPNWFFEPDIAADIVGNLLFGLFESDGWVSREQTGALRVGYTTTSEQLAHQIHWLLLRFGVGSTVRDYDPTQKRPSIVNGRRIQSKRQVFEVRISGMDNVTAFAESVPMWGPRGAALIQAIPEATQGRRRGSQATYLAAEMTDAVLNYLDERGVTAQEAAAMIGVASGDPRGGMKQVLGASRLRRDRVQALADALDDKFLHDMLAEELRYSVIREVLPTRRARTFDLEVEELHTLVAEGVVVHN

SEQ ID NO: 249 - protein, 416 aa, Mycobacterium vanbaalenii PYR-1
  Mvan DnaB intein
ALALDTPLPTPTGWTTMADVAVGDLLIGADGKPTRVVAATEVMVGRPCYEVEFSDGTVIVADAEHQWLTETRASRKSAQAAAVGYNRYKNQRTFAAVRTTREIGETLRCPTADRRLNHSVVNAAPIEAPVADLLLPPYTLGAWLGDGTSRAAQITTADPEILMRIEAEGLVTVPLPGARMRYGLQLPTEAPAGTRECVVCGASFTPSTSQVRTCGRSCGGRARFVSEPVAAPTCSHCGGPSCGLRLCQSCRNAVGTVQGRLRTIGVLGNKHIPTEYLRASEAQRRALLAGLLDTDGTVTNGGAVQFSVTSRRLAADVAELVVSLGYRCQVATKAVKGRTEASSTAYILNFSTTDSVFGLHRKDLSHKERRSKSSVRSNTRFIVDVREIETVPVRCVEVDNDDHMYLASRSMIPTHN

SEQ ID NO: 250 - protein, 425 aa, Nocardia farcinica IFM 10152
  Nfa DnaB intein
CLPASTRILRADTGAESTLGELLASGEQPLVWSLDERMRMVARPMVKVFPSGRKEVFRLRLASGREVEATGNHPFLTVDGWIPLDRLTVGDRLATPRSVPEPVHTERMADAEVVLLAHMIGDGSCVRRQPVRYASIDEQNLAAVSEAAEHFGVTAVRDDYAAARVTTLRLPAPYRLSRGKRNPIAAWLDELGLFGLRSHEKFIPRRVFALPNDQVALFLRHLWATDGSVRWDSTYRQARVYYTSTSRRLIDDVAQLLLRLGVHGRIRRVTKPGYRDAWHLTIDGADNQTVFLRDVGVHGARGDAAQVALAELEPLVRNTNVDTVPNEVWNQVRHLLATKNITHREFSAAMGSRFCGSTMWKRSPSRSRLARVAAVLDDADIEMYATNDVFWDKIVEITSLGEQDVYDGTVPGTHNFVAQSISVHN

SEQ ID NO: 251 - protein, 409 aa, Nocardia farcinica IFM 10152
  Nfa RIR1 intein
CFPAGTPVDTIDGPKPIESLRAGDRVLSHDGSYATVEKLIENTNDQPLVSISHFGHKEPIRCTPEHPILVWTDRDVETLIDGDGADPFNGFVWLAAQDVHPSDFIVATAPLETRERRVFDLMNHVGEGTYEEVDGLIRKVNTDARHRNKQRHRQGFVAVTRYVEESYDLGLILGWYLAEGHVSKRSGVEDVRPTGVHFTLGANEIERHVELGMAFKQVFGVDLVLHTNHSDHSTRMVCNSKIVASLLLSLAGTGYSTKRLAHEVMTADEDFQRGLLVGLFRGDGCTTTGGMVLDLVNQELIDQVQLLLRRLGIVSVVRTYTNQAGNPTGQVFVPGLPGTNEEFIFDVDKNLQNYTGRKGTKRTTYQVVHGRHVYGIRAVERTGETPRQVYNLHVEGTHTYTIRGAVVHN

SEQ ID NO: 252 - protein, 517 aa, Neosartorya fischeri
  Nfi PRP8 intein
CLAKGTRLLRYDGSEIEVQDVKEGDLLLGPDGGPRRAFNIVNGEDRLYRIKIDGSKEDLVVTPNHILVLHREKRATTFESMPSTNAEEPGNGDDDELPEVSAAERYDTVEMTAAEFAALSTEERSRYRVFRCPGFELPEQSVPVNPYFLGLWLGDGNSRSTTIYNSHGETVREFLVNHAAELDMYLTWHGQLGYATVPDTIEHRPVVRQARQTIRKLRLAAKSIAQPEVSEGLMPSQGSTEEPSQASTIKPVHQASMVEQKADLDLLETDSEDEEADSADEDELGDPDASEFRPEPESQLSQSHFSNRRRNHRLRTGRRAYGDLNGDEEDELLHQIVEQSEGSRVDSLPRALDALGVIAQKETGPETDRKHIPSIYMKNSRSVRLAVLAGLIDSDGWYVYPENMLGFAQSERCHSKLFWDVVALARSLGLSVWTKRHMMWNPARTERYPQLFAQISGNVAEVPCLLARKKGVERLIPQTHSFMIKDISLEPETTEWAGFRVDKDQLYLRHDYLVLHN

SEQ ID NO: 253 - protein, 155 aa, Neosartorya glabra FRR2163
  Ngl-FR2163 PRP8 intein
CLAKGTRLLRYDGSEVEVQDVKEGDLLLGPDGGPRRAFNIVSGEDRLYRIKIDGSVEDLVVTPNHILVLHRESAAESYDTVEMTAAEFAALSTEERGRYRAFRSPSFELSEKAVRVNHRFMIKDIRLELETTEWAGFRVDKDQLYLRHDYLVLHN

SEQ ID NO: 254 - protein, 169 aa, Neosartorya glabra FRR1833
  Ngl-FRR1833 PRP8 intein
CLAKGTRLLRYDGSEIEVQDVKEGDLLLGPDGGPRRAFNIVNGEDRLYRIKIDEGIEDLVVTPNHILVLHREKKAGNNEDDGLPEVSAAERYDTVEMTAAEFAALSTEERSRYRAFRCPGFELSEKAVPANHSFTIQDIRLELESTEWAGFRVDKDQLYLRHDYLVLHN

SEQ ID NO: 255 - protein, 339 aa, Natronomonas pharaonis DSM 2160
  Nph CDC21 intein
CVDGDTSVTLASGDEKPIRDIVESTLEDPTEISDGFYQESDIDVLTTDGGAVAPGRATKVWKRQAPEKMYRIRTESGRELEVTPSHPLFVQSEGGLSPLVADDLSENDFVAVPRALPADDGDDFGQHVDDLGSVTARKTADAEAVRSEDAATTPDVIPNVGDQLRRIRTSLRLSQHDCGLPRSTYQQYERGDRNPSRSRLQTVLTAFERRIEQLSSLSDRVDDGDSDAIAAARDELNPSQASLASGMDATRTAIGDDERTEARPDGGAVADAERAVADALCRALAVADDVERLRSLADGDIGWDRIDSIEPVEPEDEWVYDLEVESTHSYLSNDVVSHN

SEQ ID NO: 256 - protein, 401 aa, Natronomonas pharaonis DSM 2160
  Nph PolB-1 intein
CFSGDTDVATPDGIKNIQEVAVGDPVYTLNPETFECEIKPVVDTQSYRNKYGELHHVAGRTHDFKVTENHRFLLSETVDLDSPGPDDYALSEYRELPEYERLAFPNHEPMAGATREEFDLAGAVDDGHAVVCAHDGRSAFRTAMPAGVEAALDRADGTSQLAATEEKTGTYRIPIDTYRERRDVIDEHADEVLLKYEREDNQIPTGFGMDDWLELVGWFVTAGRFAHEAKRIVLRRQDEEGRSAIRSLLERMELPYDADGTRVTVSNRVLYDWFVKNCGDGATETRLPEWVFELDAAHLRTLLETLVDGDGSRTDSGLGEFWTQSDRLKDDVVRLAVRCGEKPTVSENQDGTWYVSVGTRGSMKKSNATVEDHDGDVHCITAEDNHVVLAGRNGHLQWVGQ

SEQ ID NO: 257 - protein, 409 aa, Natronomonas pharaonis DSM 2160
  Nph PolB-2 intein
CFTPDTEVLTPDGVRNIRALDIGDEVYSLDPETMEMEVKPVVDTHAYPDYRGELVDIQTGEIDFRVTPNHRMLVRKNGTNGITDDEYRFVEAGALDLATTYELPHDWAGPDGEDVTQIDLTELIDEEYEVWVRPEVHGRTFTAELGWKPRRVPKADIDTVGYVFTADEFKQHREYIESVCEQSYIRRESGLKWIPRVYDGDDFLELLAWYVTEGNAHTSERKEFDGQRHGSSTVQIAQEPVVADGGDTHATIGTLLDRMGFDYDNDNGSYQVTSKLLGDLFCTLGGGGSEDKRIPQLVFEASRRQKERFMQTLISGDGDRQPNSWQYNTASERLRDDVLRLCAHLGVPASYSEESGVYRIYVTEDGTNTLRMDRSAERTTADDGVYCVTVEDNHTLLAGRAGKFQFVGQ

SEQ ID NO: 258 - protein, 492 aa, Natronomonas pharaonis DSM 2160
  Nph rPol A'' intein
SIPADEQVVVRRNGETELTEIGPLVDSLMDSRETRSFDDHEVTLAPDGIEVPSLSSEETVEWKPIEEVSRHETPDELLRFELESGRSIRATKAHSFVTRQENEVVPVAGEELEAGDWLPVVASLDATDTQETVDLRKYLPAGDYWYTSVLADGGAEAVPGGPDQLRNKRAALEAGELAEHTAYPVQGTVGLPEQFPLDEETGFFVGAWLAEGSLADHYVSISNVDAAFQSRIRSFAERFDLTVNEYENDSGFAAGYDIRLNGTILSDFLRAACTDDGEKSIPGFAIGANEAFLKGLLQGYFSGDGNVGTNAIRSSSTSDRLTAGVGLLLARFDVYATLGQQEDSRTLRVPKKHVSRFDNRIGMVGERGAELEALAESADSDGPDATDQIPNFGDALEAVAEAADIPQRQVNSATKRQRIDRSRLARLVAAAEAELDGEQSELDALRQAVTGDVVWDRIESIETVESDHEYVYDVSVEGLETFTTADGVVTHN

SEQ ID NO: 259 - protein, 322 aa, Nostoc punctiforme
  Npu GyrB intein
CFIGDTLIPLADGKSYRIKDLMDWGTEFIVYACTPTGKIVAAQATAKLTRRNAPLVKVILDNGEEIICTPDHQFMLRDGTYKEAQLLQAETSLMPFYSKTDKDGYTLITQPYSSRWQKAHWIIARSGLLGKVPRFEGQKTFIHHQNFDESDNRPENLEFMGNRDHSAYHRSLVERNQHWHSAEFEEKRVASLAQKAKTSEGYQYYAERGTRNIFQYMEQQPEHFKNAVAGNGNRGKQYLVEYNKTEKGRGKSQEIANRYYTCEICGVDVKTPIGLHNHRRKEHQCNHKVVAVNLLNYTEDVYCLTVPEYHNFALKAGVFVHN

SEQ ID NO: 260 - protein, 169 aa, Neosartorya quadricincta, strain NRRL 4175
  Nqu PRP8 intein
CLAKGTRLLRYDGTEVEVQDVKEGDLLLGPDGGPRRAFNIVNGEDRLYRIKIDEGIEDLVVTPNHILVLHREKKARNNEDDELPEVSAAEPYDTIEMTAAEFAALSAEERGRYRAFRCPGFESPEKAVPVNHSFMIKDIRLELETTEWAGFRVDKDQLYLRHDHLVLHN

SEQ ID NO: 261 - protein, 352 aa, Nocardioides species JS614
  Nsp-JS614 DnaB intein
ALALDTALPTPSGWTTMGDVQVGDQLYDAHGRPTTVVAATEVLTGRPCYEVEFSDGSRIVADAQHQWLTESRAARKSRWAADKQYNRARNQNIVASVVTTEAIAGTLRVGADQRANHAVLTADPLSGSDVDLPIPPYVLGAWLGDGHSASARITCETPEIPMYLEACGLRVDHQGAMLYSLKFPDGDPRGSVQGVLRTIGVLNDKHIPADYLRASEGQRRDLLAGLMDTDGTVVRGVGSCQFAVTNKRLADDVYELVVSLGYKCGRTTRRVQGRSPETSTCHILNFSTVDDVFRLERKHLLHKEERPVTRARIARRYITAVRPIESVPVRCVEVDNTEHLYLAGESMIPTHN

SEQ ID NO: 262 - protein, 312 aa, Nocardioides species JS614
  Nsp-JS614 TOPRIM intein
CLAGETKVLTWDGPRPISELAGGTHRILNVHGDWAEAPLKSYGVQRLWRIVVTRNRERKELFATDGHRWFVPSGRTGSKHREVLTKELKAGDRLVSKFPRSRIQRTTPSPFGIAHGFTYGDGTRSGTGSMALLRPPKDLAMLKWFSNSHTSASGDNLLVHHLPRFFKELPDPDESVSYLYGWLAGYFAADGCVAADGTVILNSARRENLEFVRMVTTRLGIATYGITTQSRVGLGKEHSDLHRVHFVNDDLTESFFLLDEHRRRFAEATKKYARRGWVVQAVEETDRVEEVYCAEVEDGHAFTLEDNILTGN

SEQ ID NO: 263 - protein, 407 aa, Nostoc species PCC7120, (Anabaena sp. PCC7120)
  Nsp-PCC7120 RIR1 intein
CLPEDALVHTAKGLVPIRDVQVGDLVQTPLGFRRVVDKFDQGFQDVYEIETNATYPRATLNHRQAVLEDAKGGIVWKHIASLEAGDRLLHNKQVLPGTVTHLPADFTESRPSHSRTAKSFVVPELTAEVAWLIGFTHGDGYVALGRNKYDKPYGRVEWSMNSLDAEVTSRIQAKIDAALALFGLSAVHSITKGENTAKSICSSIRLAEYFHRHIKQPNIPLTVPSFILQGSVDIRAAYLAGLMDSDGAVNNRPPHLITSVYRSFIRQVSVVLSSLGIAGRLTTTYPQNSNWQVKYNLTIPALKERYNALISPHSAKGELRQGLKMYGFTVPGAVMRETYTYSEMREMGFQGSRTVDANYERYVAEADISLDIPVTVKGLGSYDHVQTYDIEVDEAHCFYCDGYLTHN

SEQ ID NO: 264 - protein, 164 aa, Pyrococcus abyssi
  Pab CDC21-1 intein
CVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHN

SEQ ID NO: 265 - protein, 268 aa, Pyrococcus abyssi
  Pab CDC21-2 intein
CVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHN

SEQ ID NO: 266 - protein, 394 aa, Pyrococcus abyssi
  Pab IF2 intein
CLLPDEKVVVPSVGFVTLKELFETASKVVERDDEKEIRELDERITSVNGDGKTGLVKASYVWKVRHKGKVIRVKLKNWHGVTVTPEHPFLTTKGWKRADQLRPGDYVAVPRFIHGNEDEKIFLSYVKVKKSGEEWKEYFYLAGRKGNIDVNLLFVAPKRYVVEFLRGYFEERSEVKGESVIVEARELVEPLSLALLRFGIFSKIQGSKLIVTGKRNLEAFKDYIGFKDEREKALEEAIEKVKGSEVYPIFEEIRRLRLLFGFTREELGSYAKYENSEAPTYEELMEILDFIERGSPSLSKKIAILEGKLKAELRVLEEEGLIKDGKLTPLGRELLEVWRNREFDSKDVDYIRNIAETLVFIPVENVEEEEYDGYVYDLTTETHNFIANGILVHN

SEQ ID NO: 267 - protein, 196 aa, Pyrococcus abyssi
  Pab KlbA intein
ALYYFSEIQLPNGKEFIGKLVDELFEKYHDKIGKYKDMEYVELNEEDTFEVISIGPDLSARRHKVTHVWRRKVKDGEKLVKIRTASGKELVLTQDHPVFVLLGRDVARRDAGNVKVGDEIAVLNTRPDFSVLSPPAMPELLSEPFNYELSSIGDVAWDEVVEVDEIDAKGLGVEYLYDLTVDINHNYVANGIVVSN

SEQ ID NO: 268 - protein, 333 aa, Pyrococcus abyssi
  Pab Lon intein
CFSGEETVVIRENGEVKVLRLKDFVEKALEKPSGEGLDGDVKVVYHDFRNENVEVLTKDGFTKLLYANKRIGKQKLRRVVNLEKDYWFALTPDHKVYTTDGLKEAGEITEKDELISVPITVFDCEDEDLKKIGLLPLTSDDERLRKIATLMGILFNGGSIDEGLGVLTLKSERSVIEKFVITLKELFGKFEYEIIKEENTILKTRDPRIIKFLVGLGAPIEGKDLKMPWWVKLKPSLFLAFLEGFRAHIVEQLVDDPNKNLPFFQELSWYLGLFGIKADIKVEEVGDKHKIIFDAGRLDVDKQFIETWEDVEVTYNLTTEKGNLLANGLFVKN

SEQ ID NO: 269 - protein, 455 aa, Pyrococcus abyssi
  Pab Moaa intein
CFPPTEEAVFKFGDKVKIATFEEVAKNFKFEHKVEIDGFKGEYSIPNDLYVLTFNDGKAEWTRVTKFLRRKHEGKIRVIKTKTGRTIRTTPEHKFFVYKDGELVKKRADELEPGDELVLLWRFESEETLTEINLLEAFKDLPQEEKEKVYVRGIKDLDLTPLKEKYGDKVYYWARQDSMPLSVFYELNVDLDKEFRLGRDATTYELPSKLKITPSLAKLIGYFVSDGNYSDKDLRITVGHEDVEKEIVNILEELGLPYSFLEWEGKTKQIVIGSRLLRLVFKHVFKIPEGAPNKRLPEGFLSFPFEAKVALLSGLFNGDGYVVRGEHHLSIGYASTSKGLIRDILYLLASLGIFARVYRVPKEKMKGANHDLYKLYIAGTDLVRLVELLELREGHREKLGEIGNRKPARVKKIADFYIDVVDEVSEEEYSGYVYDLEVENEGHSFVAADGILVSN

SEQ ID NO: 270 - protein, 185 aa, Pyrococcus abyssi
  Pab Pol-II intein
CFPGDTRILVQIDGVPQKITLRELYELFEDERYENMVYVRKKPKREIKVYSIDLETGKVVLTDIEDVIKAPATDHLIRFELEDGRSFETTVDHPVLVYENGRFIEKRAFEVKEGDKVLVSELELVEQSSSSQDNPKNENLGSPEHDQLLEIKNIKYVRANDDFVFSLNAKKYHNVIINENIVTHQ

SEQ ID NO: 271 - protein, 499 aa, Pyrococcus abyssi
  Pab RFC-1 intein
CLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHN

SEQ ID NO: 272 - protein, 608 aa, Pyrococcus abyssi
  Pab RFC-2 intein
CVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHN

SEQ ID NO: 273 - protein, 399 aa, Pyrococcus abyssi
  Pab RIR1-1 intein
CIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHN

SEQ ID NO: 274 - protein, 438 aa, Pyrococcus abyssi
  Pab RIR1-2 intein
CFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSN

SEQ ID NO: 275 - protein, 382 aa, Pyrococcus abyssi
  Pab RIR1-3 intein
CVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHN

SEQ ID NO: 276 - protein, 436 aa, Pyrococcus abyssi
  Pab RtcB (Pab Hyp-2) intein
CLAPGSKVLTEHGYWLKVEELPEKFKLQGVKVYNLDEGHNDTSNVAFVAEREVETGEMAVRVTTESGRIIEGSEDHPVLTPEGYVYLGNLKEGNLVIVYPFEGVEYEERKGVILDEDAFKDEDPQVLSFLREKGLVPLRWDDPRIGTIARILGFAFGDGYLGEMGGRLTLTFYGKEETLRELKKDLERLGISANLYVRESIETTSGHSEGKSLSIELRVTSRSFALFLEKLGMPRGKKTEKAYRVPGWILEAPLWVKRNFLAGLFAADGSIVEFKGNTPLPINLTQSKSDELAENLVEFLGDVAKLLAEFGIETTLYEVKSKKGVTYRLSIVGEDSIRTFVERINYEYDPEKKVKGLIAAAYLKLKERIVKEAHEAVKDDFPTFEEFAKERGYEGGFVAEKVVKVERVKPEYTKFYDIGVYHEAHNFIANGIVVHN

SEQ ID NO: 277 - protein, 429 aa, Pyrococcus abyssi
  Pab VMA intein
CVDGDTLVLTKEFGLIKIKDLYKILDGKGKKTVNGNEEWTELERPITLYGYKDGKIVEIKATHVYKGFSAGMIEIRTRTGRKIKVTPIHKLFTGRVTKNGLEIREVMAKDLKKGDRIIVAKKIDGGERVKLNIRVEQKRGKKIRIPDVLDEKLAEFLGYLIADGTLKPRTVAIYNNDESLLRRANELANELFNIEGKIVKGRTVKALLIHSKALVEFFSKLGVPRNKKARTWKVPKELLISEPEVVKAFIKAYIMCDGYYDENKGEIEIVTASEEAAYGFSYLLAKLGIYAIIREKIIGDKVYYRVVISGESNLEKLGIERVGRGYTSYDIVPVEVEELYNALGRPYAELKRAGIEIHNYLSGENMSYEMFRKFAKFVGMEEIAENHLTHVLFDEIVEIRYISEGQEVYDVTTETHNFIGGNMPTLLHN

SEQ ID NO: 278 - protein, 522 aa, Pyrococcus furiosus
  Pfu KlbA intein
ALYDFSVIQLSNGRFVLIGDLVEELFKKYAEKIKTYKDLEYIELNEEDRFEVVSVSPDLKANKHVVSRVWRRKVREGEKLIRIKTRTGNEIILTRNHPLFAFSNGDVVRKEAEKLKVGDRVAVMMRPPSPPQTKAVVDPAIYVKISDYYLVPNGKGMIKVPNDGIPPEKAQYLLSVNSYPVKLVREVDEKLSYLAGVILGDGYISSNGYYISATFDDEAYMDAFVSVVSDFIPNYVPSIRKNGDYTIVTVGSKIFAEMLSRIFGIPRGRKSMWDIPDVVLSNDDLMRYFIAGLFDADGYVDENGPSIVLVTKSETVARKIWYVLQRLGIISTVSRVKSRGFKEGELFRVIISGVEDLAKFAKFIPLRHSRKRAKLMEILRTKKPYRGRRTYRVPISSDMIAPLRQMLGLTVAELSKLASYYAGEKVSESLIRHIEKGRVKEIRRSTLKGIALALQQIAKDVGNEEAWVRAKRLQLIAEGDVYWDEVVSVEEVDPKELGIEYVYDLTVEDDHNYVANGILVSN

SEQ ID NO: 279 - protein, 454 aa, Pyrococcus furiosus
  Pfu RIR1-1 intein
CIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGEDYKFIFDYWLAGFIAGDGCFDKYHSHVKGHEYIYDRLRIYDYRIETFEIINDYLEKTFGRKYSIQKDRNIYYIDIKARNITSHYLKLLEGIDNGIPPQILKEGKNAVLSFIAGLFDAEGHVSNKPGIELGMVNKRLIEDVTHYLNALGIKARIREKLRKDGIDYVLHVEEYSSLLRFYELIGKNLQNEEKREKLEKVLSNHKGGNFGLPLNFNAFKEWASEYGVEFKTNGSQTIAIINDERISLGQWHTRNRVSKAVLVKMLRKLYEATKDEEVKRMLHLIEGLEVVRHITTTNEPRTFYDLTVENYQNYLAGENGMIFVHN

SEQ ID NO: 280 - protein, 382 aa, Pyrococcus furiosus
  Pfu RIR1-2 intein
CVVGDTRILTPEGYLKAEEIFSLAKERGKKEAVAVEGIAEEGEPYAYSVEILLPGEEKVEYETVHGKVLAVADPVAVPAYVWKVGRKKVARVKTKEGYEITATLDHKLMTPEGWKEVGKLKEGDKILLPRFEVEEEFGSESIGEDLAFVLGWFIGDGYLNVNDKRAWFYFNAEKEEEIAVRIRDILVKHFGIKAELHRYGNQIKLGVRGEAYRWLENIVKNNEKRIPEIVYRLKPREIAAFLRGLFSADGYVDKDMAIRLTSKSRELLREVQDLLLLFGILSKIYEKPYESEFHYTTKNGEERIYRSKGYYELVITNYSRKLFAEKIGLEGYKMEKLSLKKTKVDQPIVTVESVEVLGEEIVYDFTVPNYHMYISNGFMSHN

SEQ ID NO: 281 - protein, 425 aa, Pyrococcus furiosus
  Pfu VMA intein
CVDGDTLILTKEFGLIKIKDLYEKLDGKGRKTVEGNEEWTELEEPITVYGYKNGKIVEIKATHVYKGASSGMIEIKTRTGRKIKVTPIHKLFTGRVTKDGLVLEEVMAMHIKPGDRIAVVKKIDGGEYVKLDTSSVTKIKVPEVLNEELAEFLGYVIGDGTLKPRTVAIYNNDESLLKRANFLAMKLFGVSGKIVQERTVKALLIHSKYLVDFLKKLGIPGNKKARTWKVPKELLLSPPSVVKAFINAYIACDGYYNKEKGEIEIVTASEEGAYGLTYLLAKLGIYATIRRKTINGREYYRVVISGKANLEKLGVKREARGYTSIDVVPVDVESIYEALGRPYSELKKEGIEIHNYLSGENMSYETFRKFAKVVGLEEIAENHLQHILFDEVVEVNYISEPQEVYDITTETHNFVGGNMPTLLHN

SEQ ID NO: 282 - protein, 168 aa, Pyrococcus horikoshii OT3
  Pho CDC21-1 intein
CVDYDTEVLLGDGRKRKIGEIVEEAIKKAEKEGKLGRVDDGFYAPINLELYALDVRTLKVRKVKADIAWKRTTPEKMLRIRTKRGREIRVTPTHPFFTLEEGRIKTKKAYELKVGEKIATPREEAPEAEIFWDEVVEIEEYKPNNSWVYDLQVPEHHNFIANGIFVHN

SEQ ID NO: 283 - protein, 260 aa, Pyrococcus horikoshii OT3
  Pho CDC21-2 intein
CVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHN

SEQ ID NO: 284 - protein, 444 aa, Pyrococcus horikoshii OT3
  Pho IF2 intein
CLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHN

SEQ ID NO: 285 - protein, 520 aa, Pyrococcus horikoshii OT3
  Pho KlbA intein
ALYDFSIIQLSNGRFVLIGDLVEELFKKYSDKIERYKDLEYIELNDEDRFEVVSVGPDLKANKHIVSRVWRRRVREGEKLIRIKTRTGNEVILTRSHPLFAFSNGDVVRKEAGNLKVGDRVAVMMNPPKPPQTKAVVDLSIYAKISDYYLVPNGKGMIKVPNKGLPPEKAQYLVSVNSHPVKLVREVDEKLSYLAGVILGDGYISSNGYYISATFDDEDYMEAFVSVISDFIPNYIPNVKENGKYMVVTVGSKIFAEMLSRIFGIPKGRKLEWDVPDIVLSNDDLMRYFIAGLFDADGYVDENSIILVTKSENVARKIWYALQRLGIISTVSRVKNKGFKEGEIFRVIISGVDDLAKFARSIPLHHSRKRAKLMEVLKTKKTHRGRRAYRVPISAEMIAPLRQMLGLTVSELSKLASHYAGEKVSESLIRHVEKGRVKEIRRSTLRGIALALQQVAKDVGDEEAWVKARRLQLIAEGDVYWDEVVSVEEVDPKELGIEYVYDLTVEDDHNYVANGILVSN

SEQ ID NO: 286 - protein, 475 aa, Pyrococcus horikoshii OT3
  Pho LHR intein
CVSGDSKVLTEKGPVEIRHLNSGMIVGINGFKSRFVKFQELHQVKYQEYGVKIRTQLGFEVKCTREHRFLTIDKNGELRWVEAWRLKEGDYVGIIRKLPSPNSKVLILDFLPESTYLWLNKEFLKKLKVSIKEKFGSIKNYAKERGFNSSYLVKQLNGLSPFRWGRLRVILNDVSIEISRDDIERITSRRGKYSLPPELTPGIARLLGFWMASGSLNRNTLIFYSQDKKILERYEDLCKREFRVKGRIKAQDKGTYILEIPSSLLSFVFKNLARPKLEVPPIIYILPEKHKEEFLAGYFDGNGFIKIENGRIHSLGFFAFNRKFAEGIRDILLQLGILSSINEQTFEVSIIEGEKFLKIVNSWRSNYYKEWEDVIPNLEKRLKEIEEKLGYPGTYNRREIRRSELKAIIKLYEKVARERGLNDVLKELSYLKELSEGDIFFDRITSIEPVYLDVAYGIINSETGNYVVNGFVSKN

SEQ ID NO: 287 - protein, 474 aa, Pyrococcus horikoshii OT3
  Pho Lon intein
CFSGEEVIIVEKGKDRKVVKLREFVEDALKEPSGEGMDGDIKVTYKDLRGEDVRILTKDGFVKLLYVNKREGKQKLRKIVNLDKDYWLAVTPDHKVFTSEGLKEAGEITEKDEIIRVPLVILDGPKIASTYGEDGKFDDYIRWKKYYEKTGNGYKRAAKELNIKESTLRWWTQGAKPNSLKMIEELEKLNLLPLTSEDSRLEKVAIILGALFSDGNIDRNFNTLSFISSERKAIERFVETLKELFGEFNYEIRDNHESLGKSILFRTWDRRIIRFFVALGAPVGNKTKVKLELPWWIKLKPSLFLAFMDGLYSGDGSVPRFARYEEGIKFNGTFEIAQLTDDVEKKLPFFEEIAWYLSFFGIKAKVRVDKTGDKYKVRLIFSQSIDNVLNFLEFIPISLSPAKREKFLREVESYLAAVPESSLAGRIEELREHFNRIKKGERRSFIETWEVVNVTYNVTTETGNLLANGLFVKN

SEQ ID NO: 288 - protein, 460 aa, Pyrococcus horikoshii OT3
  Pho Pol I intein
SILPDEWLPIVENEKVRFVKIGDFIDREIEENAERVKRDGETEILEVKDLKALSFNRETKKSELKKVKALIRHRYSGKVYSIKLKSGRRIKITSGHSLFSVKNGKLVKVRGDELKPGDLVVVPGRLKLPESKQVLNLVELLLKLPEEETSNIVMMIPVKGRKNFFKGMLKTLYWIFGEGERPRTAGRYLKHLERLGYVKLKRRGCEVLDWESLKRYRKLYETLIKNLKYNGNSRAYMVEFNSLRDVVSLMPIEELKEWIIGEPRGPKIGTFIDVDDSFAKLLGYYISSGDVEKDRVKFHSKDQNVLEDIAKLAEKLFGKVRRGRGYIEVSGKISHAIFRVLAEGKRIPEFIFTSPMDIKVAFLKGLNGNAEELTFSTKSELLVNQLILLLNSIGVSDIKIEHEKGVYRVYINKKESSNGDIVLDSVESIEVEKYEGYVYDLSVEDNENFLVGFGLLYAHN

SEQ ID NO: 289 - protein, 166 aa, Pyrococcus horikoshii OT3
  Pho Pol-II intein
CFPGDTRILVQINGTPQRVTLKELYELFDEEHYESMVYVRKKPKVDIKVYSFNPEEGKVVLTDIEEVIKAPATDHLIRFELELGSSFETTVDHPVLVYENGKFVEKRAFEVREGNIIIIIDESTLEPLKVAVKKIEFIEPPEDFVFSLNAKKYHTVIINENIVTHQ

SEQ ID NO: 290 - protein, 410 aa, Pyrococcus horikoshii OT3
  Pho r-Gyr intein
CVTPDTLVSLSDGRIIEIREAVENSEESLLGINGLKPKEAKALKFWEIDWDGPIKVIKLKNGHEIKATPDHGLLVMRDGKIGWVSAKNIREGDYVAFIYNLGHRGGKKYTLPQLLKELGISEYENSSSQELNNREQEMDSKQISIELDERFWYIFGVILGKGTLKGDKVVIFQKDVKPVIEEALPFVRIFESADHIGFSHLILAEVFRRLGVGEGKLHSLVFGLREEYINAMIAGYFDASGTFLRRAVLTSKRGDILRMLSVYLYQIGIVNNLRRDEHAGVWELIISDLEKFREKIYPYLRIKKSQFDKVYSISKNEGDFLPVASIFRKLKFRDGFKNRILDEEIPRDEVAKVLEYAEDSPEKEFLNSLVEARVTWVRVEKIEERHYTGKLYDFTTTTENFISNGIVSHN

SEQ ID NO: 291 - protein, 172 aa, Pyrococcus horikoshii OT3
  Pho RadA intein
CFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHN

SEQ ID NO: 292 - protein, 525 aa, Pyrococcus horikoshii OT3
  Pho RFC intein
CLTGDTKVIANGQLFELRELVEKISGGKFGPTPVKGLKVIGIDEDGKLREFEVQYVYKDKTERLIRIRTRLGRELKVTPYHPLLVNRRNGEIKWVKAEELKPGDKLAVPRFLPIVTGEDPLAEWLGYFLGGGYADSKENLIMFTNEDPLLRQRFMELTEKLFSDARIREITHENGTSKVYVNSKKALKLVNSLGNAHIPKECWRGIRSFLRAYFDCNGGVKGNAIVLATASKEMSQEIAYALAGFGIISRIQEYRVIISGSDNVKKFLNEIGFINRNKLEKALKLVKKDDPGHDGLEINYELISYVKDRLRLSFFNDKRSWSYREAKEISWELMKEIYYRLDELEKLKESLSRGILIDWNEVAKRIEEVAEETGIRADELLEYIEGKRKLSFKDYIKIAKVLGIDVEHTIEAMRVFARKYSSYAEIGRRLGTWNSSVKTILESNAVNVEILERIRKIELELIEEILSDEKLKEGIAYLIFLSQNELYWDEITKVEELRGEFIIYDLHVPGYHNFIAGNMPTVVHN

SEQ ID NO: 293 - protein, 385 aa, Pyrococcus horikoshii OT3
  Pho RIR1 intein
CVVGDTRILTPEGYLKIEDLFRMAKERNNGEKVVAVEGIAEGGEEFAYPVAILLPNEEEKEVIYETVHGKQLAIADPIEVKAYVWKVGKKKVARIKTKEGYEIIATLDHKIMTKDGWKAVEDLKEGDLIVLPRFEVEDNFGSESIGEDLAFVLGWLIGDGYINTDDKRVWFYFNAEKEEEIAQKISEILKKRFNSKAEPHRYGSEIKLGVRGEAYKFFEKIVKTNDKRVPEIVYHLKPNEIRAFLRGLFTADGYVDNDGAIRLTSKSRELLRDVQDLLLLFGIISKIYERPYKGTFEYTTKEGEKKVYTAQGYYELVIANYSRKLFAEKIGFEGEKQKKIKLNKTKIDEPYARVESVEIIGEEIVYDLTVPGIHSYISNGFISHN

SEQ ID NO: 294 - protein, 376 aa, Pyrococcus horikoshii OT3
  Pho VMA intein
CVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHN

SEQ ID NO: 295 - protein, 370 aa, Pelodictyon luteolum DSM 273
  Plut RIR1 intein
CVTAETLVATDRGLERIGELVGQSRGIRGIEGKLHWVEKIFPTGTKEVYELRTKAGYRLKLTGDHPVYTENRGDVKACELSKDDVVRLVGAEFGKESTGSVDVAQLIGLLVGDGCITRNAELTASGEQRRVAFLAMDKAEAEITGWANTLINDLRPELGEHNKQGSLTQTLTSSRVAVGSPRILNLLENYAVLDGGSEKKMFSDAVFRLQQAEQAALLRGLFTADGTVANYGVKSRYVALDSTSLDLLLQVQLLLLNFGIKAKIYENRRAGDLVSMLPDGKGGMREYPVQEMHSLRISRSSRVLFQESIGFMEESRKAEALARLNMTVDTYRDPLVDRVASLRSIGRQPVFDLTEPENHHFIANGIGVHN

SEQ ID NO: 296 - protein, 374 aa, Polaromonas naphthalenivorans CJ2
  Pna RIR1 intein
CVTADTRLATQHGLVPIGWLQANGGALDCTVDRRALGEDRRGTVTRAAVPAFLSAGQAEVFKVTTAEGYQIKATAWHEFYTARGKLKLSELKAGDELWVQSGKGQFGAQGSGALGLLIGLITGDGHFTNRGKDEQAAVISLWGEERQLADDIAGSVNALIAGTSLAPRDYLVKPVAVAERNMVFIRSTMLVRVLDGYGFNGETKLEVPEVVWRGSEACMRGYLQGLFQTDGTVNVSSNSQSCSVRLSSSHRPLLQDVQVLLANFGVFSRIHERREAGPRSLPDGQGGQRDYLCQTQHELIVDGESREAFMREIGFLLPAKREKYDAWVADKALVKTQRFAATITAIEPAGVEPVYDTTQPDGNTVIFNGLVTGQ

SEQ ID NO: 297 - protein, 380 aa, Polaromonas species JS666
  Posp-JS666 RIR1 intein
CVTADTWVMTTAGPAQVSELTGRSFSAVVDGKAYAVTSDGFFRTGHKPVLALRTREGPALRLTADHRVRRVARRTRYTLEAEWTEAGQLQPGDEILLHDHRALGGWEGAGTHAEGYLLGLLIGDGTLKSDKAVISVWAPELKVAGGGAVAYAQTGAGGIVQAAEAAAATLSHRVDFRGFQRSISGRGEARMASGAVRHLAHEMGMRPGHKTITTAMEKASSVFTEGLLRGLFDADGSVQGSQEKGVSLRLSQSDLSLLQTAQRMLLRLGIASTIYPNRRLAQARPLPDGRGGLRVYETASQHELVISADNLRIYAERIGFADTDKADRLDQALGSYNRSLNRERFTVTVESLTEEGSEDVFDVTVADIHAFDANGLYVHN

SEQ ID NO: 298 - protein, 262 aa, Pseudomonas aeruginosa phage phiEL
  PP-PhiEL Helicase intein
AMPLSTRVKVPNGWKALGDLKVKDIVVTPGGDTACVESIYPQGITEVYRFYFEDGRTADSHPYHLWKTTVNGVDEILTTLEVLHKARKEDVYFPLVGEINGCNPHCDTSSEVAARELVNTDVVIGDNVLELPYRDRFNIVTSVIEHVGCLISESVLSAYHENRIGMENFRRLMWSIGGTATEPVLVNGLYKVDFKHRDVGKMMTGLIGDNPRIQGMYNFSQYEDLQLKLAYWEKVENQETCCIALDNDEKLYVVDDYIVTHN

SEQ ID NO: 299 - protein, 313 aa, Pseudomonas aeruginosa phage phiEL
  PP-PhiEL ORF11 intein
QQRNSAKVRIVPKDTLKTITPQDTWKRIEHLRVGDQVLDRSGKPCQVIGIHPQGKRRLYRVITSDGRATDVGTEHLWTLKDYSNCLNGRALWNDYSTVDVINLLKKKVKLQLPLPAPVPGSEQDLPIDPYVLGLIYCGQDQDGKVIIPTRTDAVKQYVVDHLPRGVTVIQGVANSCLERTDNQPYLFNREHGLPDQYLEAPLNARRDLLQAFLDVRGKVGRGKVFIALNRVLGGQLAYLARSLGGTGKVTKNGVEITLPEEVPPFKFREENVVFDNRLLIERVTFVGDDDCTCIEVDNSEQLYLTDDFIVTHN

SEQ ID NO: 300 - protein, 366 aa, Pseudomonas aeruginosa phage phiEL
  PP-PhiEL ORF39 intein
AGVLSSKIKIPGGWKTMGNIRVGDEVVTPDGGTAKVLAVHPQGVTKVVRVHFKDGRYTDVSPDHLWKVRRHHWCNDKAMAKLTREEVEERVWRVITTNELKDYIGLSTKVYVQLIEPERNADKPFKIHPYVLGVLLGDGCISQKAVDITKPYQQLFDKVQSLLPEHLECVWRPNRKGDGEPKTFGIRFKDRRSEQHINWHIRDGLKELGLYGMRSWGKVIPEEYLHGSAKQRLELLQGLLDTDGTVDKHKSVSFSSSSKLLSLGVQYLVRSLGGMARLQERTPHYTHNGEKREGRTDYRVYIRYPRPEELFTLDHKRERAVSHQHTETLRLQVTHIEERPDEETQCITIDHPDHLYITDDFIVTHN

SEQ ID NO: 301 - protein, 248 aa, Pseudomonas aeruginosa phage phiEL
  PP-PhiEL ORF40 intein
MQPLYAKIKVPGGWKTMREMTVGTEVIAADGTVTQVTGVYPHGKQPIYRLHFEDGRYTDAGLDHLWKVFTEETQAWTVVNTRSVQTLLAKEPDGVFIPLCEPEDGPEKPFVTDQLEGSRQQRLEHLRRLMDEKGYVRDDGSLSFSSEDEVESTTVQYLVRSLGGIARKVPSTGLYRRRQYRVYIKHPRPEELFTLTNKGGYLTSKSGNQSLKLRVNRIEFIGEHEAQCISVAHPDRLYITDDFIVTHN

SEQ ID NO: 302 - protein, 150 aa, Porphyra purpurea (chloroplast)
  Ppu DnaB intein
CISKFSHIMWSHVSKPLFNFSIKKSHMHNFNKNIYQLLDQGEAFISRQDKKTTYKIRTNSEKYLELTSNHKILTLRGWQRCDQLLCNDMITTQIGFELSRKKKYLLNCIPFSLCNFETLANINISNFQNVFDFAANPIPNFIANNIIVHN

SEQ ID NO: 303 - protein, 537 aa, Pyrococcus species GB-D; identical to SEQ ID NO: 3
  Psp-GBD Pol intein

SEQ ID NO: 304 - protein, 449 aa, Pichia stipitis CBS 6054, taxon:322104
  Pst VMA intein
CFAKGTKVLMANGDDKNIEDIAVGEEVLGKDGLPREVVALPRGRETMYEVSEKTQHRAETVFGTASYTCNATHKLVLQTNQRVNITNHVLRGESQTSVTYFQMKTAVADGREIELPKLCTKSFQHSSHGRENAWKKAEVFASTISRDPIDWTAEARDISRLGYHVRRATRQLWSPVLVEKEVLAPMIAKRGFDESIAPYMAYLVGLWVGDGYSDRATFSIDIQDVEIHERIKDFASHAGLTPRIACYKKSRDATISLHNSETRGKNVRQNLNTGNLLWSLLAEICGKKENEMLFKLVPSFLRSESIAVREYFISGLVDSDGHVKRDEADKCYSATVKTIYPAVRDGLVSVARSLGIQTSVSVEEAKEVNSVKHQESYAIYMANSSALDSVLSKCAAPRKRAEEPVCVNREPHPYTFHMVEKEEDDFYGITLSEDSDHQFLLSNLALVHN

SEQ ID NO: 305 - protein, 148 aa, Pseudomonas syringae pv. tomato str. DC3000
  Psy Fha intein
CFAAGTMVSTPDGERAIDTLKVGDIVWSKPEGGGKPFAAAILATHIRTDQPIYRLKLKGKQENGQAEDESLLVTPGHPFYVPAQHGFVPVIDLKPGDRLQSLADGASENTSSEVESLELYLPVGKTYNLTVDVGHTFYVGKLKTWVHN

SEQ ID NO: 306 - protein, 333 aa, Picrophilus torridus, DSM 9790
  Pto VMA intein
CVTGDTPVLLADGTVMSIEDIYNKSSGTVEYKNENETLIRLDEPLRLYSFYNGHVNESTSNYIYKGKSDSIIKIRTASGREVKVTPVHKLFRFVDDKIIETEARYLNTGDFIASIKRFNNKDENYLSGDESELLGLYASYGSIEDGILIDASIKDRFINLAMNIFKLKTIKIEYRNDRVLIKNDGLKDFIARMISSGIPSEVMRSRACAASFINGYLYGKLYHDDVIKLHDNEQNILKISYMLTGLGIIHSIRNNLIEIKAENMKILNSMENELIDNNETLLISNNANDDFDLYPDEIESIEILPGPFDVYDVTTPDFGSNFVGGYGAILLHN

SEQ ID NO: 307 - protein, 148 aa, Porphyra yezoensis chloroplast, cultivar U-51
  Pye DnaB intein
CISKFNYLQTSLYNQLQILFNCYYKKIEVINFSAQKQQLFLAIKCSISKTGKKTVYKIITEAGKYIQLTSNHKLLTTQGWKRCDKINQNDMIAIQIKNFEEQKNVFNSFSSLTFESIQKINVTSLQIVFDLECKPLCNFISNNFIVHN

SEQ ID NO: 308 - protein, 372 aa, Roseovarius species 217
  Rsp Rir1 intein
CVTAETWVMTDEGARQVSALLDRPFRAVVNGIAYDSGEHGFFCTGLKPVKRLSTACGRHLRLTADHLVRKVVGKTRWRQEVEWVPAGDLRPGDEVKLHDHRTAMIQTRPEDERGYLLGLLIGDGVIRDDKTLISVWPQEECIGAQPLGHPVMHKVEALLRDLPHRADFAGWQKVEGRGEYRIGTAALTALAAEYGLTRGRKTITPEIEGAETAGFGAAVLRGLFDADGSVQGAQEKGVSVRLAQSDLALLQAAQRMLARLGMNAVIYENRREAGRAFLPDGKGGQAHFETKAQHELVISGENLATYQERIGFTDVAKARRLAVALSGYKRALNRERFSAVVADVVDDGMAEVFDVQVPGVNAFDANGFYVHN

SEQ ID NO: 309 - protein, 299 aa, Salmonella phage SETP12
  SaP-SETP12 dpol intein
CLHRHTQVLTDGGFKDIMAVTSTDKVWSGEKWVNTKGAHLMGWKPVINVDGVLMTEDHKILTHSWKQAKQLVSNKYMMDRALEIGMDAWLSCASYQNDKAKDNYSSNVIVERCLGGSIMTMSGRVKPLNATAAPLKQQKNIVNSISATKTQCRMMRTERDYSTGCPRRSREQQAPGIRVIKTMGQEASRYSTSGGLIKGLFLDMFKLWKAGMTRTSKWIESTQTVTTNLETFGLSAVLKTAGTDGKYLSFNESMMQPLPALLNLNGKLTYCEPVYDLIDVEDGNRFLIASDSGFLVAHN

SEQ ID NO: 310 - protein, 299 aa, Salmonella phage SETP3; identical to SEQ ID NO: 309
  SaP-SETP3 dpol intein

SEQ ID NO: 311 - protein, 348 aa, Salmonella phage SETP3
  SaP-SETP3 Helicase intein
CLKRGTEVIMFDGTTKKVEDVIVGDVLMGPDSTPRNVLSLGRGREMMYEVKPRKGESYTVNESHILSLRTTTGIAKGSWPDNTVFDISVRDWLKLPKYVTGPNGYLKGWRVPVDFPRKEQDEALLPPYLMGLWLGDGTSSSGAITSGENEKEIRAYLESYAARNGMQIRKEGLTWSISHGNTGHKKHGFTHALKSAGVLNNKHIPHNYKCGDRRQRLELLAGLLDSDGYCDLSKAGFDWISVSERLADDFCYLCRSLGFAAYKKKTCKRCANTDVWGDYFRVSVSGDFSEVPFVRGRHQNLPKRNINKNVLNVGIESITPVGVDDYFGFTIDGDSRFLLGDFTVTHNT

SEQ ID NO: 312 - protein, 299 aa, Salmonella phage SETP5; identical to SEQ ID NO: 309
  SaP-SETP5 dpol intein

SEQ ID NO: 313 - protein, 338 aa, Streptomyces avermitilis MA-4680
  Sav Helicase intein
AQPLDSLVLAPTGFRRMGDLREGDEVVVPNGEIALIDGVFPQGVRDVWRIVLSDGSSVECDDEHLWIVGTSCGWHRGQTPKVMTTREIRLDTFKANGSSKWYVPAATPVDLGPDVGLPLDPYLFGLLLGDGSFRHNLRLSTVDDEIRDAAADAVAPDCRLVPVTGSRCDYTIQLKQRSGGVRNPVIQALRRLDLWGKTSHGKFIPEDFKNTSIKNRLSLLQGLLDTDGTVHADGMSVSLRSASLRLAEDVAWLVRSLGGRARVLPEKAAFHVSVALPDEYAPFRLSRKADRVRPRPKYNTFRRGIRAVEYVGRKPAQCISVGHPSHAYVTDNFTVTHN

SEQ ID NO: 314 - protein, 517 aa, Saccharomyces castellii, strain CBS4309
  Sca-CBS4309 VMA intein
CFAKGTEVLMADGSDKAIEAIEVGEQVMGKDGAPRTVIALPRGTETMYEVCHTTQHRNGNEKFGLMNYVCSGNHKLVLRTPQLIRTTIHELRGKHYTSVTFFVTEKSANGTIVKQRTKTFQHEFHGGEEAATKLAADFASTIDPKHIDWDIEAKDYKQLDHYVKKSSYQMINPVFKESGNLANILGDAGIEKTLAAKMAWLLGFWVGNGHMETAQFPVDSWDTQLVDRISEYGKHFNLTTTTENHYRSNHVESNKDIEIFEMNEAQIEEAEQTGVVAFDSNRKGDPSETELIEAEIFNESRPSTAGLFTPAAISPASLVTDLSVTLRGTGIGGAGVSKERNLNNIFWDIVTSFGVRTNGQGSTYEKSVPLHLSYDDIEVREQFIAGLIDSDGYVKSADNRFSATVTTIYKGVSEGLIRLARSLGIRVSVSTEKEHVDKNNVKHKSCYRVFLSGEALIGVLRFCALDRKRTAFKEFTREAVPFYFTLQEKDQDEYYGITLPDETDKQYLLSSLALVHN

SEQ ID NO: 315 - protein, 454 aa, Saccharomyces cariocanus, strain="UFRJ 50791
  Scar VMA intein
CFAKGTTVLMADGSIECIENIKIGDKVMGKDGKPREVIKLPRGNETMYSVVQKSQHRAHKTDSSREVPDLLKFTCNSTHELVVRTPRSVRRVSRTMKGVEYFEVISFEMVQKKVPDGRIIELVKEVSKSYPASEGPERADELVESYRKASTKPYFEWTVEARDLSLLGSHVRKATYQTYAPILYENDYFFNYMENSKFHPTIEAPKVLAYFLGLWIGDGLTDRTTFSIDSRDTSLMERVTEYAEKLDLCAEYKDRKEPKVAKTVNLYSKSVRANGIRNNLNTENPLWDAIVGLGFLKDGVKNIPSFLSTDNIGTRETFLAGLIDSDGYVTDEHGITATVKTIHTSVRDGLVSVARSLGLVISVNAEPAKIDMSGTSHKMCYAIYMSGGDILLNVLSKCASFKKFRPAPVAPPVRECRGFYFELQELEEDDYYGITLSDDSDHQFLLANQVVVHN

SEQ ID NO: 316 - protein, 454 aa, Saccharomyces cerevisiae (nucleus)
  Sce VMA intein
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHN

SEQ ID NO: 317 - protein, 454 aa, Saccharomyces cerevisiae strain DH1-1A
  Sce-DH1-1A VMA intein
CFAKGTNVLMADGSIECIENIEVGNKVMGKDGRPREVIKLPRGSETMYSVVQKSQHRAHKSDSSREMPELLKFTCNATHELVVRTPRSVRRLSRTIKGVEYFEVITFEMGQKKAPDGRIVELVKEVSKSYPVSEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGVRNNLNTENPLWDAIIGLGFLKDGVKNIPSFLSTDNIGTRETFLAGLIDSDGYVTDEHGIKATIKTIHTSVRDGLVSLARSLGLVASVNAEPAKVDMNGTKHKISYAIYMSGGDVLLNVLSKCAGSKKFRPAPVATFVRECQGFYFELQELKENDYYGITLSDDSDHQFLLANQVVVHN

SEQ ID NO: 318 - protein, 454 aa, Saccharomyces cerevisiae OUT7091
  Sce-OUT7091 VMA intein
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECPGFYFELQELKEDDYYGITLSDDSDHQFLLANQVVVHN

SEQ ID NO: 319 - protein, 454 aa, Saccharomyces cerevisiae OUT7112; identical to SEQ ID NO: 317
  Sce-OUT7112 VMA intein

SEQ ID NO: 320 - protein, 501 aa, Saccharomyces dairenensis, strain CBS 421
  Sda VMA intein
CFAKGTQVMMADGSDKSIEEIQIGEQVMGKDGNPRTVIALPRGKETMYEVCHITPHRTTSGENFGVMDYVCSGNHKLVLRTPQNVTLTTHELDGQTYTNVSYFALEESAYGQIVAKKTKSYQHQRHGGKQETEKKVNEFLATINPDSIEWDVEAKDYKKLGYNVKKSSHQMINPVFKESGNLIAKLNELGFSKEIAPQMGWLLGFWVGNGSITTSSFSIDSLDTQLLDRITEYGKLFALTTTSATNHCRNYSGSGNQDIELSKINNGKVETDGTITFDDDTEREPSEQELIDMESSGCKASSEMTVALGAPLVRGNAIRQLLTENNVFLKLIESFGVRKENGSEYVKAIPMHLSYDDIEVREQFIAGLVDSIGHVKRTSNGTIECAAISTAYKSVSEGLIRLARSLGIKVSVTTKRECLDKHNVKHQICYSICLSGATLSGALRFCALDKNNANSKKPFVRGPVPFYFTLKEKDEDNYYGITLPDSTDKQYLLSSLALVHN

SEQ ID NO: 321 - protein, 384 aa, Staphylococcus epidermidis RP62A
  Sep RIR1 intein
CVTGDTELLTEKGYVKAKDLYESQEDLKVVIDNRTKNYDINNKGTDIVNAIPMQLTAKQAEIYEITTKQGFKIKSTEWHKYYRKINDSIEKVQLNQLEVGDKLLVQSGNGSYGDFHDPKLAFLMGLIAGDGTFGRDGSVKIYLYHEKQYLKETIEELVAYIIDKYRNKNEFLHHSANLHPKFVENKELQKLTISSVELYKILSRFGFNRETKLRFPNLLKNATKNTITAYLSGLYQMDACVNTNEKYKAMSIELTTISEELARDIQMQLLNLGVYSSIYQSEREISLLPDGNGGMKEYKVQNTYKISIQDRSSRDLFMKEVALKPKDIHKAMIFNLTLRPNSRKPKHDFTAEITEIKYIGKEDVYDTTQEDYHSLIFNGIVTGN

SEQ ID NO: 322 - protein, 499 aa, Saccharomyces exiguus, strain="IFO1128"
  Sex-IFO1128 VMA intein
CFAKGTQVMMADGSDKSIEDIQLGENVMGKDGTPRTVISLPRGKETMYEVCHSSTKGTTKDTLMNYVCSGNHKIVMQTPQQIGITEHGIDGKTYTSVSYFALRDSQHGYPIVKKLTKSFEHQQHGGKEQTLITVNNFVSSLKSEPINWDVEAKHYESLGHYVKKCSYQLINPVFHQSGKLAQEIASLNYSKDKAPLLAWLIGFWVGNGAMRHSQFVVESQDIELVNRIQDIAGLLNLSATTACYYSGSKDDEAKLAKLNSSSAEGFEDDLEGNPSVKELADMDRLSESKTATLPTAFGVENIDELIISLGEGRGNGNVFAQVIGSFGIDLADKDTLVTKIAHELAGDAFEVREQFVAGLVDAAGYVRKDVYDHASEATISTESKSTVLGLVKIARSLGIKITVTSDDSDDSDEHDHAHCGHDHGSSSSYTAVMTGDALTNSMRFCAIGRNRVAAKEFMRQAVPFYFSLEKKSEDDYYGITVPDNTDKQYLLSSMALVHN

SEQ ID NO: 323 - protein, 390 aa, Stigeoclonium helveticum, strain UTEX 441
  She RPB2 (RpoB) intein
CLTVDHEVLTTKGWIPLNKVKTSHFVATLKKNGQLVYQNPTNIYHYPEFKGELYHIKNVNLDLLVTLNHRMYVKNGIIEATSSVDYQLIPAKDIVGQHKKYCKTAFWDKENYQFILPSVISNSIVIPEKTMNMEAWLQFFGIWIAEGWALTNTISNNNVTNFNQSSSSPYVVQISIKKKKVLEILNNVIPILGYSFNYYDNNITICDKQLWAYLRPLSLGNPYRKLPIWVWDLSQDQARVLLLAMITVFKNGTNSKWEKAASLSSRLSLASVFPEFLKKRIDKGLSYYTSSVELADDISRLALHAGWSGNNYLLKKKGSISSFDGKQIICQFDIWRISIIQSKNQPAVNHGYHSKGKEEVLPYQGAVYCLSVPNEIFYVRRNGLSVWTGN

SEQ ID NO: 324 - protein, 342 aa, Shigella flexneri 5 str. 8401
  ShP-Sfv-5 Primase intein
ACPLNEPILLADGTWTTHGNVKIGDQVASVDGNPSTVTGIFPQGVRDVYRVTFEDGRYVDCAGDHLWEVTSRGFTKGEKRRVIDTFGLKRLSETKRHKNGVRIPEITGDFGDHSEPLAWVIGSLLGDGSLSNGSVKFSNVEPYMIERMKAELPDYNFSGDGKDWLISTARGQVNPLMETLRGYGLMGCTAKNKFIPRVFFSANKSTRIGMLCGLLETDGYVEKDGTLVFSSASEELRNGVVQLVNSLGGSCRTRVKTGVTYTYKDDKQHGMDSYEARIRLTREIREAIRSPRLNGRLTAHRFEGCGVFVRNVEKIGNAECLCIMVDHPRHLYVTRGYVATHN

SEQ ID NO: 325 - protein, 480 aa, Staphylothermus marinus F1
  Smar 1471 intein
SVSYDTPVLIRDPINKIHLVKIGEFIDKFYEEGEERTAKHVNGYYVLSHDGFQVVWKPIKYVLRHRTNEIYEIIYEGGGKLEATGSHSVFVLDPDTLDIVEKPVMLLNKGEYLVSFNGVKENKDHQTIDLIDLVSDYNDVYVDNIPSELKKHTGGRNPIPLKQYMILRKRVITKKNNSLIKLRRSKYTLPIRLVLDEKLAFLFGAYIANGCVKERRDKLICFTFGKSAKNIADKVMNIMYEKFNIKPFIDDRGTYIIYEYPHTLLAIIFEKLLGRKLEEKKMPEILWSSPKSVIRAFFEGLRAYSQRTLRRRYTSYTTANKNLAYQLLWLARFAGFYSVLKEEKEAGKNNGKTYYHVIVYLDQSYRKPNASERVPVKPILKLIKYTKPRTMPPELAYIKRREFISRKTALKALEWIRRDGSFTDFSREYLRKIESLINGDIIVLKIKDVRKKQYKGYVYDISVPITEAFFGGNIPILLHN

SEQ ID NO: 326 - protein, 350 aa, Staphylothermus marinus F1
  Smar MCM2 intein
SYHKDFKIMLADGRKVRIGDLVDELIGKNREKVIKGKDTEILFVDDLFLLSYNMRSGEQVLVKADRVSRHKAPDQFIKLRFSNGAEIIVTPEHPVLIINNGKIKTVRADTVRKGTLTIGVLGHKIIKEVNEDDIINNIRRKIVLDKELPYIHAKNISEAVEMRDQLMSIDIPTFIVKHKNEIRLYPSGPCSLRRLLLMHGVEEVVFSDELLYEIMNCHLYPATWYELLYSMGLTKIAKELNVYDFEILAGIIKKVEKEVIMLSQVLGLRNETQTELLHLKSRRELLIRLKDKLDMLRKRLKDLEEALGKDAVIRMITDVEVIKNTDSDWVYDITIEPYHLFVSDGLILHN

SEQ ID NO: 327 - protein, 454 aa, Saccharomyces pastorianus IFO11023; identical to SEQ ID NO: 317
  Spa VMA intein

SEQ ID NO: 328 - protein, 136 aa, Spirulina platensis, strain C1
  Spl DnaX intein
CLTGDALILSDRGWLRIDDPTLQECRVLSYNESTQQWEWQQVLRWLDQGVRETWKIKTFQTEIKCTGNHLIRTDKGWIKAANITPKMKILSPEIDAAVKTALQDVESIEKLGVNHVYDIEVEHNHNFVANGLLVHN

SEQ ID NO: 329 - protein, 344 aa, Salinibacter ruber DSM 13855
  Sru DnaB intein
CLGKGTPVMMYDGRTKPVEKVEVGDRLMGDDGSPRTVQSLARGREQMYWVRQKRGMDYRVNESHILSLKKSRREGARDRGSIADISVRDYLDQSDKWKDDNKGFKVAAEFPDQPVPLDPYFLGLWLGDGKSDNARIYTTDEEVITGLQEIAEKRGDTISVSDEHRRCPAYLVKSGDRGGAMATRESVQGALRALGVLGDKHIPHLYLGNSRGKRLRLLAGLIDSDGHLNDGHGGTYEITQSSEQLARDIKFLCDTLGYRTSLTQKTARISSTGYESEVHRVRFNGNVDEIPVRVERKKASPWTDVRDWRMTGIDVEPDGVGDYFGFTLDGNGRFLLGDGTVTHN

SEQ ID NO: 330 - protein, 358 aa, Salinibacter ruber DSM 13855
  Sru PolBc intein
CFDPETEVVTVDGIRHVEEIEVGDRVYSLNPDTGAVEIKPVTATQSQHYAGPMVEIKNQHTDFLVTPNHRFLTQRFTSGEYTDLEWETAGDMLGDRIRRRLPSLRSLPATQERPGPISLSAVCDRLAIEHKTGPRGIKELRRQARWQPEEYELTDWLRILGWFATEGTLYKSKARQYENGNVRGVSYQTTLCQKNDIGRSEIATLLNRTGITYSSDQNDHSFCSKVLYEILEAECGSDSFSKHLPPWIFQLGPKDLKIVFDTLMQGDSAANGDRFTTSSNQLAEDFIRLAMHIGRRAFHMPNDGSHRIQVNTVRGQRPTIKPKHRQQVDYDGMIHCLTVADNHTVLAGRNRKFNWTGQ

SEQ ID NO: 331 - protein, 430 aa, Synechocystis species, strain PCC6803
  Ssp DnaX intein
CLTGDSQVLTRNGLMSIDNPQIKGREVLSYNETLQQWEYKKVLRWLDRGEKQTLSIKTKNSTVRCTANHLIRTEQGWTRAENITPGMKILSPASVDVDNLSQSTALTASLGGLSGAINYEAINTDKKNTTLSLSLKKQKPQDPFVNADVAKNLIFQHFCSAKEEKLKVSNPIGEDIPTKKATDFGISEQKKLHQGQNRWEQKFSVLSTEPCLGMEVLTIPTHIADSPACDGPTAPSSQNGWNIKRQDWDVCHPKYDSQPIKAMGKVPSAVKPVVPQTLLMFSAQSNLEVKENKFLRNGSRISLKKEWLGGTWTTVPSLFPNLGVHQFSYTQRAFSRKKINLLLNGLPIEDIPPVQNPIAEALTAKPITTQKWEQWPPASGYRTWKSIPSPQWHTNFEEVESVTKGQVEKVYDLEVEDNHNFVANGLLVHN

SEQ ID NO: 332 - protein, 435 aa, Synechocystis species, strain PCC6803
  Ssp GyrB intein
CFSGDTLVALTDGRSVSFEQLVEEEKQGKQNFCYTIRHDGSIGVEKIINARKTKTNAKVIKVTLDNGESIICTPDHKFMLRDGSYKCAMDLTLDDSLMPLHRKISTTEDSGITIDGYEMVWSPRSDSWLFTHLVADWYNRWQGIYIAEEKQHCHHKDFNKRNNNPDNLIRLSPEKHLALHRKHISKTLHRPDVVEKCRRIHQSPEFRRKMSARMQSPETRAILSKQAQAQWQNETYKLTMMESWRSFYDSNEDYRQQNAEQLNRAQQEYWAQAENRTAQAERVRQHFAQNPGLRQQYSENAVKQWNNPELLKWRQKKTKEQWTPEFREKRREALAQTYYRKTLAALKQVEIENGYLDISAYDSYRISTKDKSLLRFDRFCERYFENDENLAREAVLNYNHRIVNIEAVSETIDVYDIEVPHTHNFALASGVFVHN

SEQ ID NO: 333 - protein, 141 aa, Synechococcus species JA-2-3B'a(2-13)
  Ssp-JA2 DnaB intein
CLAGDTQVMDADRGKIWRLDQLAALPAAAELPRLLSLNGRGRLVPQQPVKVFCSGRQPTCVLKTRLNFSIRATGNHPFLTPDGWKTLDELQLEEEVAVVVQEGLIWDPVVLISEPGEPQPVYDIEMPRHHNFVANGLLVHN

SEQ ID NO: 334 - protein, 369 aa, Synechococcus species JA-2-3B'a(2-13)
  Ssp-JA2 RIR1 intein
CVTADTWVHTGDGPRQVRDLIGKQHSTYVNGELFSTTPEGFFYSGTKPVLKLLTKEGFSLRLTGNHRVLKVTAQTQKAQYTEWVPAESLQPGDRILLHNHRDLTSWDGAGTWEEGWLLGNLLGDGGLTATPWNDTALLRYWQDTQAEMSQYAIQLLQTAVGYEPRQPEAYHYAQLGLRVIGSRGLAKLAAQFGMRPGQKQMTEALEATSFQFHRGFLCGLFDADGSVQGNQEKGVSVRLSQSHLGTLKAVQRMLARLGIIAVLYENRRPAGYRLLPNSARQPAPYACKAQHELVIANDNLHLFQEWVGFREPHKAQKLEALLNGYKRQLNRERFAVTVAALEADGVEPVYDCTVPGPACFDANGFVVHN

SEQ ID NO: 335 - protein, 141 aa, Synechococcus species JA-3-3Ab
  Ssp-JA3 DnaB intein
CLAGDTRVRDVDRGKIWRLEQLAALPPSAELPRLLSLNGRGRLVPQQPVRVFCSGRQPTCLLKTRLNFSIRATGNHPFLTRDGWKTLDELQLEEEVAVVVQEGLIWDPVVFISEPGEPQPVYDIEMPRHHNFVANGLLVHN

SEQ ID NO: 336 - protein, 369 aa, Synechococcus species JA-3-3Ab
  Ssp-JA3 RIR1 intein
CVTADTWIHTGDGPRQVKDLIGKQHSTYVNGELFSTTPEGFFYSGTKPVLKLVTQEGFSLRLTGNHRVLKVIAQTPKAQYTEWVPAEELRPGDRILLHNHRDLTPWDGEGTWEEGWLLGNLLGDGSLATTQGNDTAVLRYGQDTQQERSLHAAQVLQAAVGYEPRRPETCYHPKLKCWVIHSTGLARLAAKFGMAPGQKQMTAALEATSFDFHRGFLCGLFDADGSVQGGQEKGVSVRLSQSNLDTLKAVQRMLARLGIVSAIYENRRPAGYRLLPDSKRQPAPYACKVQHELVISGDNLHQFQAVVGFREPRKAQKLGELLGSYQRRLNREWFTVTVAALEPDGVEPVYDCTVPGPSCFDANGLVVHN

SEQ ID NO: 337 - protein, 420 aa, Staphylococcus phage Twort
  StP-Twort ORF6 intein
CISMDSMILTTEGYKSLQEIFETQGVKVDNKEKVIELKYPLINRYGDVEYTSHFTKNGEKPTKRIKTNKGIELVNTYNHPLLVREGFNLIWKKSEDIEVGDILVSRVGDHQFGNNNTVENEEEAYALGCMVADSYLGSYSRLSFSNDKKEILDKVSKFWNTFSNKEVYYDTYKESKGITIHLHDTNKTKEFHDKYKIEYGVAKDKKIPKCIMESPENIQLAFVSGYLECESSISEKNLEVTSASKDLLKDLQLILSNIGIVSTNKEKVVKKYKHNKYYRLIVNRKELIKLLPLLRFETQQRKNQKENFLSNNTKIKSSYGNTIEGSRYLLKKYRDSLNIDKKEFSKYLSRDTITIDRLREVISLYPDGDKEIRELFENVVNNNIYYQKVEQVLEGEIIPTFDVCMPKTHSFIANTIVNHN

SEQ ID NO: 338 - protein, 414 aa, Saccharomyces unisporus, strain CBS 398
  Sun VMA intein
CFEKGTEVLMADGTDKVIEDITIGEQVMGKDGQPREVVGLPRGKMTMYQVCHKATEQNEIALMDYVCSGNHKFVLVTPQNVKITEHMLRGKMYTSVNYFVANDFENGQVVKLRTKTFQHDIHGGADGAKVEAQKFASTIDLSPISWEIEASKYVELDVNVRNATTQLINPVFYESGKLASRLQTKNIDQTSADKLAYVMGSWVGAGSMDQPTFAGNQLDEEFVSRLTEYGSGLDLTKNNSVWDIINESGLRTLNANGEATKTIPKELVSDSISVREHFIAGLVDTQGNVKRASTGAVETASISTVYERISNDLVKLARSLGIKASVSQQEEHVDAKGVDQQQTYNIKLTGSALNGVVRLSALSKNRDEPVSFERLPVPFHFTLLEKAEDNYYGVTLPDATDKQYLLSSLALVHN

SEQ ID NO: 339 - protein, 173 aa, Thermoplasma acidophilum, ATCC 25905; identical to SEQ ID NO: 89
  Tac-ATCC25905 VMA intein

SEQ ID NO: 340 - protein, 174 aa, Thermoplasma acidophilum, DSM1728
  Tac-DSM1728 VMA intein
CVSGDTPVLLDAGERRIGDLFMEAIQDQKNAVEIGQNEEIVRLHDPLRIYSMVGSEIVESVSHAIYHGKSNAIVTVRTENGREVRVTPVHKLFVKIGNSVIERPASEVNEGDEIACASVSENGDSQTVTTTLVLTFDRVVSKEMHSGVFDVYDLMVPDYGYNFIGGNGLIVLHN

SEQ ID NO: 341 - protein, 360 aa, Thermococcus aggregans
  Tag Pol-1 (Tsp-TY Pol-1) intein
CHPADTKVIVKGKGIVNISDVKEGDYILGIDGWQRVKKVWKYHYEGKLININGLKCTPNHKVPVVTENDRQTRIRDSLAKSFLSGKVKGKIITTKLFEKIAEFEKNKPSEEEILKGELSGIILAEGTLLRKDIEYFDSSRGKKRISHQYRVEITIGENEKELLERILYIFDKLFGIRPSVKKKGDTNALKITTAKKAVYLQIEELLKNIESLYAPAVLRGFFERDATVNKIRSTIVVTQGTNNKWKIDIVAKLLDSLGIPYSRYEYKYIENGKELTKHILEITGRDGLILFQTLVGFISSEKNEALEKAIEVREMNRLKNNSFYNLSTFEVSSEYYKGEVYDLTLEGNPYYFANGILTHN

SEQ ID NO: 342 - protein, 538 aa, Thermococcus aggregans
  Tag Pol-2 (Tsp-TY Pol-2) intein
SILPNEWLPIIENGEVKFVKIGEFIDRYMEEQKDKVRTVDNTEVLEVDNIFAFSLNKESKKSEIKKVKALIRHKYKGEAYEVELNSGRKIHITRGHSLFTIRNGKIKEIWGEEVKVGDLIIVPKKVKLNEKEAVINIPELISKLPDEDTADVVMTTPVKGRKNFFKGMLRTLKWIFGEESKRIRTFNRYLFHLEELGFVKLLPRGYEVTDWEGLKRYRQLYEKLVKNLRYNGNKREYLVRFNDIKDSVSCFPRKELEEWKIGTAKGFRAKCILKVDEDFGKFLGYYVSEGYAGAQKNKTGGMSYSVKLYNENPNVLKDMKNIAEKFFGKVRVGKNCVDIPKKMAYLLAKSLCGVTAENKRIPSIIFDSSEPVRWAFLRAYFVGDGDIHPSKRLRLSTKSELLANQLVFLLNSLGVSSIKIGFDSGVYRVYINEDLPFLQTSRQKNTYYPNLIPKEVLEEIFGRKFQKNITFEKFKELADSGKLDKRKVKLLDFLLNGDIVLDRVKNVEKREYEGYVYDLSVEDNENFLVGFGLLYAHN

SEQ ID NO: 343 - protein, 1986 aa, Trichodesmium erythraeum IMS101
  Ter DnaB-1 intein
CAAYDTLVLQKDGSLVTLAEVYKRQEIELLTLGKNSKFYLTKPSAFIDDGIKPIFRVTTKLGRFVETTITHPFLTVNGWKPLSKLQVGEKIAVPRRLNIFGNETISESKFSSLINFDNLYLFPLVFQLERSQLALFIRYLFSLDGWVKIYQNKIVCFGYSTVSEKLIRQIQHILLRFGIVSGIEKFEEKRTEKIKVVKEVKSQRSHREEFTFATYRNCYCDGKWHLTITDALSQKNLMEDIGGFDSKNFYLFDLLQPHNSGNQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTTKRNSPKNSENLTTTETICRKNILANMENLPSDNQNFDSEKLDLPQPHNSGTQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGTQELENSDIFWDKIVSIEPVGEKQVYDLTVPETHNFVANDICLHN

SEQ ID NO: 344 - protein, 1365 aa, Trichodesmium erythraeum IMS101
  Ter DnaE-1 intein
CLPKGTLIDQPDGSREAIENIKSGEVILTSDGRKVWEAKVAKQWRSGVREILKITLSSGTVIYSGKNHRFLTPEGDKFAWELQPQVGRVKNALIYGSAVYEKWQVSSNQKQLRKNDAYLLGLLVGKSNLISSTPNVSFSTQGAITWGKNLIDETWGGEAKHYFDTSRRQVYLNFNTQSKPTALTEFLDGIYGAQNWQVESVAKHLPEDILDYSEKDRIDLLRGLWDSGGFDGKKLLYYPGSSPQLLSQVCQLLGSLKIDYYLADNSVRISDRSRFIDILENYQMSSQQKEEISESYLPASSWFLKGGSENNIQKTDSSSRKTGEASQQKATLFTQNLFSAQTPAENWEKVGENHLLSSWFLTDASENNIQKTDSSSRKTGEASQQKATLFTQNLFSAQTPAENWEKVRENHLLSSWFLTNASEIYLQRIDSSSRKTGEASQQKATLFTQNLFSVQTPAENWEKVRENHLLSSWFLTDASENNIQKTDSSSRKTGEASQQKATLFTQNLFSAQTPAENWEKVRENHLLSSWFLTNASENNIQKTDSSSRKTGEASQQKATLFTQNLFSAQTPAENWKKSRKNHLPSSWFLKGGSENNIQKTDSSSRKTGEASQQKATLFTQNLFSAQTPAENWEKVRENHLLSSWFLKDASENNIQKTDSSSRKTGEASQQKATLFTQNLFSAQTPAENWEKVRENHLLSSWFLTDASENNIQKTDSSSRKTGEASQQKATLFTQNLFSAQTPAENWEKVRENHLLSSWFLTDASENNIQKTDSSSRKTGEASQQKATLFTQNLFSAQTPAENWEKVRENHLLSSWFLTNASENNIQKTDSSSRKTGEASQQKATLFTQNLFSAQTPAENWKKARENHLLSSWFLTNASEIYLQRTDSSSRKTGEASQQKATLFTQNLFSVQTPAENWKKARENHLLSSWFLTNASEIYLQRTDSSSRKTGGASQQKATLFNQNLFSVQTPAENWEKVRENYLLSSWFLTNASEIYLQRTDSSSRKTGEASQQKATLFTQNLFSVQTPAENWKKARENHLLSSWFLTNASEIYLQRTDSSSRKTGGASQQKATLFNQNLFSVQTPAENWKKARENHLLSSWFLTNASEIYLQRTDSSSRKTVEASQQKATLFTQNLFSAQTPAENWEKVRENYLLSSWFLTNASEIYLQRIDSSSRKTGEACQQKATLFNQNLFSAQTPAENWKKVRENHLLSSWFLTDASENNIQKTDSSSRKTVEASQQKATLFTQNLFSAQTPAENWKKSRKNHLPSSWFLTDASENNIQKTDSSSRKTGEASQQKATLFTQNLFSVQTPELENWECEKTYLQDVRVVHVVSVEEVGEAECFDLEMEDQSSPYFLAEGVVVHN

SEQ ID NO: 345 - protein, 244 aa, Trichodesmium erythraeum IMS101
  Ter GyrB intein
CFAGNQKVILADGRRLSFAEIVAEQAEGKEHFCYTINQSGNVAIERIINARITKKNASVIKIILDNNETIICTPDHLFMLRDGSYKPAALLTGNDSLMPLSQKSSQKTENSQELDGYEMVWSPQKESWIYTHLLPDFYNLKAGVYQSANGDSCYHVGFKKLNSTKTEGLLTEKHLEFHKTNLELAYRCSERDEFLARDIIPNYNDHYNYRVVSIEPLEERLDVYDIEVPNTHNFALASGVFVHN

SEQ ID NO: 346 - protein, 336 aa, Trichodesmium erythraeum IMS101
  Ter Ndse-1 intein
CFDSKTEILTEAGWVAFPNLQSEVKVATLNSEGKVEYHIPEEYIVQSYIGEMYRFANTNFDFCVTPNHWMYVRNKTGNLEFIRADEAKLWQSLEVLTGGDFEGEKEEWLELRKSPINSHRKVEKIFMDDWLEFLGYYISEGRVDVKKSLRVVGGNDAYVADYNILIGQENSELALKIASCLRRLGFNFSEILFDSDKHQFRVCSKQLAEMLLPLGKSGEKYIPRELLKLSKRQLLILFKALIMGDNSEQKNHYTYYSKSKRLADDIQELALRCGYAATVVSHAVGRDLYQVNIRPAEDANLVVPERFHYVGKVYCVNVTNHVVFVRRNGRAAWCGQ

SEQ ID NO: 347 - protein, 430 aa, Trichodesmium erythraeum IMS101
  Ter Ndse-2 intein
SLTGDQKVLYYIAKKLYYETFAECYDRINGDISSVSVPCFDENYQTVIKPISAIWKHHVKKKGFKIKITWGKQIKITEDHSLFTRNENNKPQAVFGNEIKVGDEIGIPSYISFLEQPLEPFHITDKILIQEEIYVESEDTISYIEKYGDKMREYLLAKSLSPSQFYSILKTYEAKNQIPWHLWKYLELPLSEKDKVCYLSKKAIKNWIDNVEELLWFLGFYVARGSLIKNEVVLKGEPSQLEKVIELIERIFEYKSEINDSGYISIKSKILVDLIGYGLNFGNQEKDIPNWILQLPEQQLIRFLKGFVAGNNLENQLNFYLEFKTDSQLVAEKLVLILSKFGLVADVSEIEVNEEDIAKIYRIIIEGLEDKNIHNLSKVEQKISALTTGDIAWGKIESIEEFEIDDYVYDFSVPNYENFIGGSYNVFAHN

SEQ ID NO: 348 - protein, 469 aa, Trichodesmium erythraeum IMS101
  Ter Snf2 intein
CVLHDTEIYVNGMVMEAEQIWQAYAGEAEFDGEGFWTEPNKELLVNSLDETTGKIVFARIRRLYRQWVREKLRKVRLKDGSSITITCRHKLFIRDSWKNDFQVGDDVCVPAKLMWDGKPEDPDVVKFVAWQVAEGWERVNSGMFGVSQKGKDVLEGLLEVFSRLGKRYDIKINCPKVVAHGSKKNCYEFSAHSLEYRKFLEEKRYGWGKRSHEKTIPLFIMQADLDSVRVFLSNYFDAEGWVNKTVRCVEISTASSQLIQELSILLRRFGVWMKISPQQKCATNGTGVFCTYYIGTFGGNSARCFLQEIGFNDSGKQENLKSICEKIADSNVEGIPASDIVAELVEKTQLPVGSLGIQDPIYMDGCQDFSPTSLEKVINSIEDIISGAGEEEYGQLKSSKLRNKTLEAYSLLNILELEIYKTRLQKLLNQEVYYCQIESIEEMEYEGWVYDFEVSKYHNFVANNIICHN

SEQ ID NO: 349 - protein, 298 aa, Trichodesmium erythraeum IMS101
  Ter ThyX intein
CLSGNTKVRFRYSSSSQEAKYYEETIEKLANLWHYGSKNQYTSKDAKCMQENISSRNIFTLDTQTNQIVSSKITNIYINGEKETYTIKTVSGKEIRATLEHQFWTNQGWKRLKDFNNSTQLCEVQLAGNKVTPQEVKFLEKEMFNEKWIPVRNYDGYKIYSLDILNSYLIQKENKEHSRSKSKNCLLPNLNYGIRYDRLSEVNINRLVMENLKLLGEYKELEVRHLNENSFNNKPKKFAWNSSKSDQIDNINNNSFSDNSGVFVEIESIEKFGKEITYDLEVEHPEHNFIANGLVVHN

SEQ ID NO: 350 - protein, 360 aa, Thermococcus fumicolans
  Tfu Pol-1 intein
CHPADTKVIVKGKGVVNISEVREGDYVLGIDGWQKVQRVWEYDYEGELVNINGLKCTPNHKLPVVRRTERQTAIRDSLAKSFLTKKVKGKLITTPLFEKIGKIEREDVPEEEILKGELAGIILAEGTLLRKDVEYFDSSRGKKRVSHQYRVEITVGAQEEDFQRRIVYIFERLFGVTPSVYRKKNTNAITFKVAKKEVYLRVREIMDGIENLHAPSVLRGFFEGDGSVNKVRKTVVVNQGTNNEWKIEVVSKLLNKLGIPHRRYTYDYTEREKTMTTHILEIAGRDGLILFQTIVGFISTEKNMALEEAIRNREVNRLENNAFYTLADFTAKTEYYKGKVYDLTLEGTPYYFANGILTHN

SEQ ID NO: 351 - protein, 389 aa, Thermococcus fumicolans
  Tfu Pol-2 intein
SVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVKLWELIGLLVGDGNWGGQSNWAKYYVGLSCGLDKAEIERKVLNPLREASVISNYYDKSKKGDVSILSKWLAGFMVKYFKDENGNKAIPSFMFNLPREYIEAFLRGLFSADGTVSLRRGIPEIRLTSVNRELSDAVRKLLWLVGVSNSLFTETKPNRYLEKESGTHSIHVRIKNKHRFADRIGFLIDRKSTKLSENLGGHTNKKRAYKYDFDLVYPRKIEEITYDGYVYDIEVEGTHRFFANGILVHN

SEQ ID NO: 352 - protein, 341 aa, Thermobifida fusca YX
  Tfus Hyp-2914 intein
CVDEETEILTTDGWKTFRETAPGDLALTLNHSTGLAEWQPILDVYVFPAQPRTMIRMEGRTHSSLTTPQHRWPVERATRTTAASEETRRERTWATTETLTDGDRIPQAAPCRDLPTEPKWSDALVELVAWLWLGDHATRSRHSATLALSQRDGLGAARIRAALHSLFGPPAPQPSRGGRRPWWRERLTRSCVEFHLSPGASRMLLEHIPDGAVSFGFLRSLTRAQLNLFIDTSVRACRAHGTTTASRTALVHRDRRRAEAFQFAAILAGYPASLRHRTLPGPAPADVWLVHLDTAQDFAPKAATPGLTIAEEPYTGRVWCVRTPNATWLARRAGTVYFTGN

SEQ ID NO: 353 - protein, 422 aa, Thermobifida fusca YX
  Tfus RecA-1 intein
CLTADTYVWTDRGLETVAEVFGRAGLPLSSTSRVTDVRDRDIRVVNEKGELEQVAALTHNGRQPVVRITVASGRQVTVTRNHPLRVMNDDGFIVWREAGQLREGDVLVSAAFGAVQAASGGGLSEDEAVLLGYLTAAGSLDPAGHVCFTTTDIETGAEFAALAEWLLDTTVTAVPGDGQVAYVLSDPAARHTLAERYGVDYAAAARIPQCVRTAGDKMQRAFLAALYTAAGWTDTSAAVGLRTASAPLAREVQYLLYGLGIPADLDRSHGNGQHPWAVTISPAAAPRFHTEVGFRTAQQSPQTGLHEPTPQVEAIPNLTGLIHALRDSIGDRAESTDDPFPAASGGAYDRDQVRRVIDWAKRRTDEAPATANAILGYLTQLTDARYTYEPITAVEDAGQQPTFDLMVPRTHSFLANGILSHN

SEQ ID NO: 354 - protein, 357 aa, Thermobifida fusca YX
  Tfus RecA-2 intein
CMHYDTLVTLADGTQEKIGTIVDRKLDVEVLSYDPETDRIVPRRVVNWFDNGAADHFLQFTVGRSGKPGGAQFTATPNHLIRTPGGWREAGELIAGDRVLVHEPHYLNEQQRQVVYGSLMGRGTLVPDRHGGPGVHFCMAHTAEQAAYLDWKVSLLGNIAHSRTAEASATVGVEFTPMPELSELHRVVDFGDGHTHLTWEFLKQLTPLALAVWYLDAGTLTIPQSGTDDDARVQIDVETLSPGSRQRLVEYLRDTHELDAAVVQQGADARSLLEFTPAATVRFLELVAPYVPESMSSMLLAQFRGRCSVTPEYSDPVQRLVAAPVLDIQVKPGSTRKFDIEVEGNHNYFVDGVMVHN

SEQ ID NO: 355 - protein, 456 aa, Torulaspora globosa, strain CBS 764
  Tgl VMA intein
CFAKGTPVMMHDGSVKAIETINVGEEVMGADGLGRKIVGLPRGREVMYKVSQKTEHRAYETDETRSAPVGLFEYTCNATHKLVVRTPRSCRTLNRTMKGVEYYEVVFFDLAKEKLKDGREIEVVKEISRSYPVTEGPERAAEIMKEYQEAGAGKQFFEWTIEARDVGALGAHVRKATHQVYAPVLYESDFFFHYVKDSKFCLKSEAPFALAYLLGLWVGDGLSDRAVFSVDSEDTTLFDRIIDFADILDLSAEYKDREIPKRAKTVGLFPKTIRGNDIGRNLNTDNPLWNAIVDLGYLKGGVKHVPSYLLTDSIPHREVFLAGLIDSDGYVRGEEAPAATIKTIHKTVMEGTVAVARSLGLTVSVNIEEAKVDKDGVNHRPAYAIYISGGDALLSVLANCASAKKHRAAPTKEVVRGLNEVYFEMKELQEDDYYGITLSENSDHQFMLANQLVVHN

SEQ ID NO: 356 - protein, 537 aa, Thermococcus hydrothermalis
  Thy Pol-1 intein
SLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRSVSYEKFRELVKSEKLDGEKAKRIEWLLNGDVVLDKVLEVKKRPYEGYVYDLSVEEDENFLAGFGLLYAHN

SEQ ID NO: 357 - protein, 389 aa, Thermococcus hydrothermalis
  Thy Pol-2 intein
SVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYNVGLSLGLDKEEIEEKILKPLKNTGIISNYYDKSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHN

SEQ ID NO: 358 - protein, 140 aa, Thermococcus kodakaraensis KOD1
  Tko CDC21-1 intein
CVAPDSIIKTNLGQFKIGELVEKAIPEKVQDYKSVNAEKLGLYIKTLDGDMRVLRLWKLRAPEKLIRIEGDGLSITVTPETKLLTPNGWVEARNVDGEVVTENGPVKVSKQEIESPHDYVYDLTVEGSHSFIANGFVVHN

SEQ ID NO: 359 - protein, 335 aa, Thermococcus kodakaraensis KOD1
  Tko CDC21-2 intein
SYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHN

SEQ ID NO: 360 - protein, 546 aa, Thermococcus kodakaraensis KOD1
  Tko IF2 intein
CLLPDEKVILPEHGPITLKGLFDLAKETVVADNEKEIRKLGAKLTIVGEDGRLRVLESPYVWKVRHRGKMLRVKLKNWHSVSVTPEHPFLTTRGWVRADQLKPGDYVAVPRVIHGNESDERFVSFVYEKLKNDELIAKLRGEVLSKISSEFKGDRAYKVERNVFRWEDIERLNLWDEVERVAFTPRMHRSGKPLHYVKLPRSPEEWEAFFYFAGVMFGDGSQDKIANNDVEVYEELKKLSVLGVAVKRVERTTSYEIELTNGKNALLRLLRVLFEYPERQKAKSIRVPRILFIAPRKYVSRFLRGYFDADGHVSLKDARIEVTSASQEFLEDLSLLLLRFGIVSKIYRSDYTTLVISGRRNLDLFRRYIGFSVKNKAEALEKAIKKSRRSESYPIFEELKRLRLLFGFTRTELNSNVPFYGKYESEEAPSYETLMRILDAIEKGSINLDKKIAVLEGRIRDHNYIKAFEKDGLIKDGKLTELGRELLEVWRNREFDSSDVDYIRNLAENLVFIPVEDIEEFEYEGYVYDVTTETHNFVANGILVHN

SEQ ID NO: 361 - protein, 523 aa, Thermococcus kodakaraensis KOD1
  Tko KlbA intein
ALYDFSVIQLSNGKFVLIGDVVEELFNKYSDRIKTYKDLEYIELDPEDQFEVVSVGPNLKAGKHTVTAVWRRKVRNGEKLIRIRTRTGNEVILTKTHPFFVFSDGDVVRKEAEKVRPGDRVAVMMRPPKAPQSPAVVPVEVYAGISDYYLVPNGNGMKKVPNRGVPPEDAEYLLSRNSKPVKLVREVGTSLAYVAGVILGDGYLSSDGYNLSVTFDDPDYMNSFTSAMSEFLPESAPRIKDNGTSTVVTYGSRIFNEMLSRIFGIPRGKKSSIWDVPDVVLTNDDLMRYFIAGLFDADGSVDETGPAVILTTKSESAARKIWYALQRLGIISTVSRVRNRGFKEGHIFRVIISSVEDLKKFDALIPLSHSRKREKLKAILKEKRPYRGRYTYRVPISPEMIKPLRTRLNLTVAELSKLASKYAGETITESLIRHVEKGRTSEIRRSALKGIALALQRIAQDIGDEDAWVMAKRLELIADGDVYWDRVVEVEEVDPEEIGIEYLYDLTVDEDHNYVANGILLSN

SEQ ID NO: 362 - protein, 525 aa, Thermococcus kodakaraensis KOD1
  Tko LHR intein
CVSGDSKILTGKGPVEIGRLNSNMIAGIWRFQTELVRFEEPHRVEYRREGVKIRTRLGFEIKATKEHKFLTVDENGELRWVEAWKLKEGNWVGVVRRLPSPNVKVSILDLLPPNAYLKLKGEFLRELKLSIQAKFGSIRTYAKKKRWSESYLVKQLNGVYPFRWERLSAVLKDLDLRMTENDVERITSDKGKYSLPIEFTPSMARLLGFWMADGSWKGGTLTLFSSDRKMLEKYKELCKEEFGVVGRIRMLNESTYSLEISFNLLPAIFKNLTGNTERKSKLGTFPSIIYSLPEEHKREFLAGYFDGDGFLEVKGGRVYSAGFSTFNKRFAEGIRDILLQLGIVSSIRAREYDEVQKFKGRVIPKKGASYTVSVLGGEYLKRFFDAVRPWRSDYEGWEGMYNEGYSNSDVVPNLGKRLRSIRERLGISAYRMSKMGFYNPVRVELGEREISRRNLRLLVEFYERVAKEKRVEDVLEELSYLRELAEGDVFFDRITSVEPAYIDVAYGIINSETENYIVEGFISKN

SEQ ID NO: 363 - protein, 360 aa, Pyrococcus/ Thermococcus kodakaraensis KOD1
  Tko Pol-1 (Pko Pol-1) intein
CHPADTKVVVKGKGIINISEVQEGDYVLGIDGWQRVRKVWEYDYKGELVNINGLKCTPNHKLPVVTKNERQTRIRDSLAKSFLTKKVKGKIITTPLFYEIGRATSENIPEEEVLKGELAGILLAEGTLLRKDVEYFDSSRKKRRISHQYRVEITIGKDEEEFRDRITYIFERLFGITPSISEKKGTNAVTLKVAKKNVYLKVKEIMDNIESLHAPSVLRGFFEGDGSVNRVRRSIVATQGTKNEWKIKLVSKLLSQLGIPHQTYTYQYQENGKDRSRYILEITGKDGLILFQTLIGFISERKNALLNKAISQREMNNLENNGFYRLSEFNVSTEYYEGKVYDLTLEGTPYYFANGILTHN

SEQ ID NO: 364 - protein, 536 aa, Pyrococcus/Thermococcus kodakaraensis KOD1
  Tko Pol-2 (Pko Pol-2) intein
SILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYSSAMATSTEQETQALNEKRALANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHN

SEQ ID NO: 365 - protein, 474 aa, Thermococcus kodakaraensis KOD1
  Tko Pol-II intein
CFPGDTRILVQINGLPQRITLRELYDLFEDERYENMAYVRKKPKADVKVYSFDPESGKVVLTDIEDVIKAPSTDHLIRFELELGRSFETTVDHPVLVYENGKFVEKRAFEVREGDRILVPNLKLPEKNIDYLDLLKEFSREEFAHLHDRIMVRGIAEWLRSVEADVKEDYLRRDSIPLSVLLRVLTEKEISIEEVPSCWLGFKRDKVRIKRFVPLKPLLRVVGYYLAEGYARESKSVYQLSFSMAEKEVREDLKRALREAFGDGFGIYERGGKVTVGSRILYLLFTEVLKAGKNAYSKRVPSLVFTLPREAVAEMLKAYFEGDGSALKSVPRVVAYSVNKALLEDIETLLLAKFGIRGYYTFDNNANRGNARGRLYHVERGTEAPVSKVYALNIAGEHYHRFFNSIGFVSERKNSIYELHAEKSPAQDRYSSQNGWLVKVRRIEYITPKDDFVFSLNAKKYHNVIINESIVTHQ

SEQ ID NO: 366 - protein, 489 aa, Thermococcus kodakaraensis KOD1
  Tko r-Gyr intein
CVTPDTLVSLADGRIMEIKDAVEKSEGNLLSVNGLKPKEAKALKFWEIDWNGPLKVIKLKNGHEIKATPDHGLLVMREGKLGWVSAKNVREGDYVAFAYNTGHRGRDEYTLLKLMIKLGITDVMVELDEEYFNEKVAPIVRERISTSTKYKYLRRRVLPLYLLQEWGLDDYEAHVKSLYRQRAGSKPIPNFKLDGRFWYVFGLVLGDGTLRDSKVLISQTPLKDVKSVLEDVFPFLRVFETTNQVGFSNSIIAEVFRRLGARKGKLHPLVFGLREEYINAMIAGYFDTDGTFSILNDRKGPNFRGILTSKRGDVLRMLSVYLYQIGIMNYLRRDERTGVWDLIISNRSLEKFREKIYPYLRIRRAQFDEAYSVYRASRRAFEGDLLPVAPVFGKLKFKNGTKNRILKETGIDVWNWLKRPEGEIPRDKLSKVLEYAEESPEKEFLKSLVEAGVTWVKVKGVEEELYTGKLYDFTTTTENFLSNGAVSHN

SEQ ID NO: 367 - protein, 482 aa, Thermococcus kodakaraensis KOD1
  Tko RadA intein
CFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHN

SEQ ID NO: 368 - protein, 454 aa, Thermococcus kodakaraensis KOD1
  Tko RIR1-1 intein
CIDGNAKIIFENDGEEHIMTMAEMYERYKDLGEFYDPEYNRWGINVEEVPVYVKSFDPSTKEITKGKVKVIWKYELGEDVPKYEIKTNKGTRVLTSPWHPFFVITQDLKIVEKRADELREGDMLVGGMPSDDDYEFLLDYWLAGFIAGDGSIDKYRSHVKGHEYVYDRLRIYDYTTETLGIINDHLEKTFGKRYSLQRDRNIHYIDIKAKGITSHYIELLRGITNGIPQPILKEGRNAVLSFITGLFDAEGHVNSKPGVELGMVNRKLIEDITYYLNSLGIKARMRKKPRKDGVDYVMHVEEYSSLLRFYELIGKNLQNSEKRIKLEELLSKHNGGSFGLTLSFEDFKAWSSKYGVEFKTNGSQTLAIIKNEKVSLGQWHRRGRVSKAVLVKMLRKLYDTTKSEDVKRMLHLIEGLEVVKEINVTNEPKTFYDLTVERYQNYLAGENGMVFVHN

SEQ ID NO: 369 - protein, 382 aa, Thermococcus kodakaraensis KOD1
  Tko RIR1-2 intein
CVVGDTRVLTPEGYIKAEELFSLAKERGKKEAVAVEGIAEEGEPYAYSVEVLLPGEEEVKYETVHGKALAIADPVAVPAYVWKVGKKKVARVRTKQGYEITATLDHRLMTSEGWKEVGELKPGDEILLPRFEIEEDFGSESIGEDLAFVLGWFIGDGYLNVNDKRAWFYFNAEKEEDIAWKIREILAKHFGIKAEPHRYGNQIKLGVRGEAYRWLESIMGSNEKRVPEIIYRLKPREIAAFLRGLFSADGYVDNDNAVRLTSKDRGLLRDVQDLLLLFGILSKIYERPYSSEFKYTTKDGEERTYRAEGYYELVIANYSRKLFAEKIGFEGYKMEKLSLQKTKIDEPVVTVESVEVLGEEIVYDFTVPEHHSYISNGFMSHN

SEQ ID NO: 370 - protein, 511 aa, Thermococcus kodakaraensis KOD1
  Tko TopA intein
CLHPDSLIPTPQGVKRIKELPEKGEVFALDFDLKLSRARYRLLERDADEPMYKVTLSDRTELYLTADHPVLVYRDDQLIFVPAEELRENDQVVLFINRSEYSPRTESPTLLGFLLENATSMKDYILYDPEFGGVLRNRIKDAGLKTEILWRFRIREPTYYKYLRGKMPVPIVRFLLEEGVVSIEELREVFRGFSYSTSLTPISFEFSEEFWYLFGLVAGDGHLAKKGAITIPAKDRTEDTVKAVKEIANSLQVPFAFDEKYKMIILRSKSLTRLFELLGCPYGNKTEIFRIPGEIMAKPEWMAAFLAGYYDADGHIGTKPTGGKKSHSPQIVLTSKNRMAIYTVKQMWQLLGVGTYLWEKKDRNGNFMAYELKVYSRDAWRFYEVMKNHLRIKRKDLEHVKEVAIRKRKAYSHHYSVLNVKSWEGKIKSSNVLWKKFDMSNQTAHGRGISLDKLQRIVDYLTDTDLRRIAMGDVYVLGIRSIEKFHYRGKVYDLVVDQYHNFIANGVVVHN

SEQ ID NO: 371 - protein, 538 aa, Thermococcus litoralis
  Tli Pol-1 intein
SILPNEWLPIIENGEIKFVKIGEFINSYMEKQKENVKTVENTEVLEVNNLFAFSFNKKIKESEVKKVKALIRHKYKGKAYEIQLSSGRKINITAGHSLFTVRNGEIKEVSGDGIKEGDLIVAPKKIKLNEKGVSINIPELISDLSEEETADIVMTISAKGRKNFFKGMLRTLRWMFGEENRRIRTFNRYLFHLEKLGLIKLLPRGYEVTDWERLKKYKQLYEKLAGSVKYNGNKREYLVMFNEIKDFISYFPQKELEEWKIGTLNGFRTNCILKVDEDFGKLLGYYVSEGYAGAQKNKTGGISYSVKLYNEDPNVLESMKNVAEKFFGKVRVDRNCVSISKKMAYLVMKCLCGALAENKRIPSVILTSPEPVRWSFLEAYFTGDGDIHPSKRFRLSTKSELLANQLVFLLNSLGISSVKIGFDSGVYRVYINEDLQFPQTSREKNTYYSNLIPKEILRDVFGKEFQKNMTFKKFKELVDSGKLNREKAKLLEFFINGDIVLDRVKSVKEKDYEGYVYDLSVEDNENFLVGFGLLYAHN

SEQ ID NO: 372 - protein, 390 aa, Thermococcus litoralis
  Tli Pol-2 intein
SVSGESEIIIRQNGKIRFVKIKDLFSKVDYSIGEKEYCILEGVEALTLDDDGKLVWKPVPYVMRHRANKRMFRIWLTNSWYIDVTEDHSLIGYLNTSKTKTAKKIGERLKEVKPFELGKAVKSLICPNAPLKDENTKTSEIAVKFWELVGLIVGDGNWGGDSRWAEYYLGLSTGKDAEEIKQKLLEPLKTYGVISNYYPKNEKGDFNILAKSLVKFMKRHFKDEKGRRKIPEFMYELPVTYIEAFLRGLFSADGTVTIRKGVPEIRLTNIDADFLREVRKLLWIVGISNSIFAETTPNRYNGVSTGTYSKHLRIKNKWRFAERIGFLIERKQKRLLEHLKSARVKRNTIDFGFDLVHVKKVEEIPYEGYVYDIEVEETHRFFANNILVHN

SEQ ID NO: 373 - protein, 455 aa, Torulaspora pretoriensis, strain CBS 5080
  Tpr VMA intein
CFAKGTKVLLHDGSLRAIESIEVGEDVMGVDGERRKVVGLPRGREVMYKVSQKTTNRAHETAETRSEPLGLFEYTCNATHKLVVRTPRSCRLLTRNENGADYYDVAFFDLVKTKLKDGREIEIVKEMSNSYLATEGPEKAAQMVKEYQEASEGKEFFEWTIEARDVAVLGADVREATYQVYSPVLYESDFFSQYVKDSKFGLTSEAPLALAYLLGLWAGDVSSEETVFSVNSEDGSLYERITQFADILGLSAEFKDREAPKQGKTVYLHPKAIGGNDIQENSNNDNPLRNAIVDLGYLTDGVKNVPTYLLSDAIPHREIFLAGLIDSDGFVRSEDGCSATIKTTLKTVMAGTVAVARSLGLNVSVNTEEAKVDNGVDQRLSYAISISVSDALLSVLAKCAGAEMFRELPASEVVRKMNKVYFEMEELEEDDYYGLTLANGTDHQFMLANQLVVHN

SEQ ID NO: 374 - protein, 535 aa, Thermococcus species GE8
  Tsp-GE8 Pol-1 intein
SILPDEWLPLLVNGRLKLVRIGDFVDNTMKKGQPLENDGTEVLEVSGIEAISFNRKTKIAEIKPVKALIRHRYRGKVYDIKLSSGRNIKVTEGHSLFAFRDGELVEVTGGEIKPGDFIAVPRRVNLPERHERINLIEILLGLPPEETSDIVLTIPVKGRKNFFKGMLRTLRWIFEEEQRPRTARRYLEHLQKLGYVKLMKRAYEIVNKEALRNYRKLYEVLAERVKYNGNKREYLVHFNDLRNEIKFMPDEELEEWKVGTLNGFRMEPFIEVGEDFAKLLGYYVSEGYARKQRNQKNGWSYSVKIYNNDQRVLDDMEKLASKFFGRVRRGKNYVEISRKMAYVLFESLCGTLAENKRVPEVIFTSPESVRWAFFEGYFIGDGDLHPSKRVRLSTKSEELVNGLVVLLNSLGISAIKIRFDSGVYRVLVNEELPFLGNRKRKNAYYSHVIPKEILEETFGKQFQKNMSPAKLNEKVEKGELDAGKARRIAWLLEGDIVLDRVEKVTVEDYEGYVYDLSVEENENFLAGFGMLYAHN

SEQ ID NO: 375 - protein, 389 aa, Thermococcus species GE8
  Tsp-GE8 Pol-2 intein
SVAGNTEVIIRRNGKVEFVPIEKLFQRVDYRIGEKEYCALEGVEALTLDNRGRLVWRKVPYIMRHKTNKKIYRVWFTNSWYLDVTEDHSLIGYLNTSKVKSEKPLKERLVEVKPRELGEKVKSLITLNRAIARSIKANPIAVRLWELIGLLVGDGNWGGHSKWAKYYVGLSCGLDKAEIEEKVLRPLKEAGIISNYYGKSKKGDVSILSKWLAGFMVKYFKDENGNKRIPSFMFNLPREYIEAFLRGLFSADGTVSLRRGIPEIRLTSVNRELSNEVRKLLWLVGVSNSMFTETTPNKYLGNESGTRSIHVRIKNKHRFAKRIGFLLDRKATKLSDNLREHTNKKMAYRYDFDLVYPKKIEEINYDRYVYDIEVEGTHRFFANGILVHN

SEQ ID NO: 376 - protein, 537 aa, Thermococcus species GT
  Tsp-GT Pol-1 intein
SLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRNVSYEKFRELVKSEKLDGEKAKRIEWLLNGDVVLDKVLEVKKRPYEGYVYDLSVEEDENFLAGFGLLYAHN

SEQ ID NO: 377 - protein, 389 aa, Thermococcus species GT
  Tsp-GT Pol-2 intein
SVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYYVGLSLGLDKEEIEEKILKPLKNTGIISNYYDRSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHN

SEQ ID NO: 378 - protein, 423 aa, Thermus thermophilus HB27; identical to SEQ ID NO: 91
  Tth-HB27 DnaE-1 intein

SEQ ID NO: 379 - protein, 423 aa, Thermus thermophilus HB27
  Tth-HB27 DnaE-2 intein
CLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTGDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHN

SEQ ID NO: 380 - protein, 438 aa, Thermus thermophilus HB27
  Tth-HB27 RIR1-1 intein
CLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYGVRVVTAKGLERYLERIGVPKGSRLEALHGIKPDVRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHN

SEQ ID NO: 381 - protein, 407 aa, Thermus thermophilus HB27
  Tth-HB27 RIR1-2 intein
CFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGPGTLQETRSNTFHLHFNRIPAEFFQALGVKAARATEKRVPESLFRAPREAVVGFLQGLFSADGSVQINENKQDATVRLASSSLALLQDVQLLLLNLGILGKIHKRREAARKALPDGKGGLREYPVAPQYELILGGENRDRFAEVVGFLQEEKQSKLLAFLRHRPRGSYRKPFLATVASVEPAGEAPVYDLTEPVTHSLIANGLVAHN

SEQ ID NO: 382 - protein, 423 aa, Thermus thermophilus HB8
  Tth-HB8 DnaE-1 intein
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVPPAVAYRISEAKRRSGLSWSEAGRRVAVAGSCLSSGLNLKRPRRYLFRHRLFLLGEAFADPGLEALAEGQVLWDPIVAVEPAGKARTFDLRVPPFANFVSEDLVVHN

SEQ ID NO: 383 - protein, 423 aa, Thermus thermophilus HB8
  Tth-HB8 DnaE-2 intein
CLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTRDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHN

SEQ ID NO: 384 - protein, 407 aa, Thermus thermophilus HB8
  Tth-HB8 RIR1-2 intein
CFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGQGTLQETRSDTFHLHFNRIPAEFFQALGLKAARATEKRVPESLFRAPREAVVGFLQGLFSADGSVQINEKKQDATIRLASSSLALLQDVQLLLLNLGILGKIHKRREAARKALPDGKGALREYPVAPQYELILGGENRDRFAEVVGFLQEEKQSKLLAFLRHRPRGSYRKPFLATVASVEPAGEAPVYDLTEPVTHSLIANGLVAHN

SEQ ID NO: 385 - protein, 532 aa, Thermococcus zilligii
  Tzi Pol intein
SILPDEWIPLLINGRLKLVRIGDFVDSAMKELKPMKRDETEVLEVSGIGAISFNRKTKRSETMPVRALLRHRYSGKVYGIKLSSGRKIKVTAGHSLFTFRDGELVEIKGEEIKPGDFIAVPGRINLPERQERINLVEVLLGLPEEETADIVLTIPVKGRRNFFKGMLRTLRWIFGEEKRPGTARRYLEHLQTLGYVRLGKIGYEIVNEEALRDYRGLYETLTGKVKYNGNKREYLVHFNDLRDIIRLMPEKELKEWKVGTLNGFRMETSIEVKEDFAKLLSYYVSEGYAGKQRSQKNGWNYSVKLYNNDQNVLDDMETLASKFFGKVRRGKNYVEIPRKMAYVLFESLCGTLAENKRVPEIIFTSPESVRWAFLEGCFIGDGDLHPGKGVRLSTKSEELVNGLVILLNSLGVSALRIWLDSGVYRVLVNEELPFLDKGKKKTPYVTSKEIPEEAFGKRFQRNISLEKLREKVEKGEPDAEKVKRVVWLLEGDIVLDRVEEVAVDDYEGYVYDLSVEENENFLAGFGMLYAHN

SEQ ID NO: 386 - protein, 434 aa, uncultured archaeon GZfos13E1
  Unc-ERS PFL intein
CFTGNTEISTDRGLFKIKDIVEKHIECRVYDYAGNFSPIKKYYKRETSSLLEIRPFLHSDAISCTLNHEFFVYNSKANEFIKKEAQYINVKEDYLVITIPQKEIFNYKLDVNNAIEDLYQELTFKQRFSNEEVIREVKELRKRGFSWRKIFKRFNLTDHLRRVIERKEALDSKILPIVKERDGKVAVKGSNFFIDKFIEVTPKFTRLLGYYLSEGCSSKDIGRKNSYYVSFTFNSKEKEYIRDTKEIFSETFKTELKEVESKKCKTLSLVSYKGIIGLFFKYYFGEDVYNKKLPTEFIYLDKDLQKQLIIGLFRGDGLTSPDFIKKYKKQRIQITSKLLRYQISLILLRLGIKYSIFRKEIIISDKRIFDLLGQSHLITKKVINTSNRYGFLDDKHLYLKINSVKKLNKKTKVYNLEIDNPTHSYNVNLISVSN

SEQ ID NO: 387 - protein, 307 aa, uncultured archaeon GZfos9C4
  Unc-ERS RIR1 intein
CVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLFDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHN

SEQ ID NO: 388 - protein, 167 aa, uncultured archaeon (Rice Cluster I)
  Unc-MetRFS MCM2 intein
SYHPLTEILLADGRKIRIGDLFDQTYAKADEIIEGIDCEIVPCEGVSVLSTDMNHITEQRVDRVSRHKAPDHFIKIRYSNDREIIVTPEHPVFIVKDGISCIPASAVTIGDPVPAPVEEQTGSKICSLYVTAVEVIPNEGQYRTDYVYDVTVEPYHCFVSQGVILHN

SEQ ID NO: 389 - protein, 433 aa, Vanderwaltozyma polyspora, formerly Kluyveromyces polysporus, strain CBS 2163
  Vpo VMA intein
CFAKGTEVMMADSSIKNIEDIEIGDLVMGQDGQPREVTQLPRGSDKMYKVNEINENSTSELFSFVCNATHQLIVRTPRNIKVQTRIIDGIECNEIVYTDLFKEITEDARIIELIKEVSKIYPVSEGMDDVQEFVSQYNKSLEDYFQWTVEPRDINRLTESIREATYQVYAPVLYECENLLQYLKNTKYNLNEKSPTALAYLLGLWTGSGMTRRAGLSVSTTDESLMNNIVAAADLLNLKSEFKQERTTTRVGNVNFYGNSTSTNQNVDNLLWDAIQELGFIQDGNKTVPSFLSSDLIEIRETFLAGLIDSNGSVDNNKQDISCTIELEDNKVMSGIVSLIRSLGLKADVTQSSGKLNDVCYNVTVKGGELLKSVLSRCSAINYTKCESRDLLREPVEFYFELQELEEAEYYGITLPEYSDHQFMLSNQVVVHN

SEQ ID NO: 390 - protein, 138 aa, Wiseana iridescent virus
  WIV RIR1 intein
CVVGETLILTENGEYPIKSLVDREVSVWNGDEWSDVTVVQTGTDQELLRIDFSNGIFIVCTEYHRFLVLDRSRPIKDLKRKYAKDLPLNFQVMYTHSDLSTTLIKVTKVSKLQRRANTYCFTEQLNNAGVFNGILTSN

SEQ ID NO: 391 - protein, 456 aa, Zygosaccharomyces bailii, strain CBS 685
  Zba VMA intein
CFAKGTEVMMHDGSVKAIETIEAGEAVMGTDGQPRKVVGLPRGREVMYKVSQKTAHRVHKTDETRAAPVALFEYNCNATHKLVVRTPRSCRSITRKMQGVDYNEVIFFDLKKKKLEDGREIEIVKEVSRSYPAAEGAEKAAQMVKDYYDAARGKEFFEWTIEARDVAELGAHVRKATHQVYAPVLYESDFFFHYVKNSKFALRSEASTALAYLLGLWVGDGLSDRAVLSVDSEDSSLLERITGYADILDLSAEYKDREIPKRAKTVCLYPKTIRGNDIRRNLNTDNPVWNAIVDLGYLKDGVKNVPSYLFSDSICHREVFLAGLIDSDGHVRGDDGLSVTIKTIHKTVMEGTVAVARSLGLIVSVNTEEAKIDKNDVNHRFVYAIYISGGDALLSVLAHCAAAKKFRAPPSNEVVRGLKKVFFEMEELKEDDYYGITLAKESDHQFLLANQLVVHN

SEQ ID NO: 392 - protein, 450 aa, Zygosaccharomyces rouxii, strain CBS 688
  Zro VMA intein
CFAKGTEVMMSDGSIKEVEGIEVGQEVMGKDGKPREVVGTPSGREKMYKVSHKTAHRAHKSDSTSERFGLFEYTCNATHKLVVRTSRSCRPLVRNIQGTDYVEVCLFNMTKKTLEDGRVIDIVEETSDFYPAVEGPEKALRILKEYAEADGGKEYFEWTIEARDVALLSAQVRKATYQLSAPVLLENNHFSHYLKDSNSAVGNDTVRALSYFLGLWIGDGMLNNAATFSVDSQNASLLNRINEFAEVLGLSAEYKDSQEPKRAKTVNLYAKAIRDEGVRKNLDTHNLLWDAIVDLGYLKDDSKNVPGYICSDSFQHREVFLAGIIDSTGYVSDETATVKTIDQSVMTGTVAVARSLGINVSVDVEVDEDGVDRSFVYAIYMDRSDALLAVLANCASNNKQIEAPPHGVIREFNKAYFEMEELEEDEYYGLTLSNESDHQFLLANQLVVHN

SEQ ID NO: 393 - protein, 696 aa, Aquifex aeolicus strain VF5
  Aae RIR2 precursor
MEKTEKNELVRKLIFNPQGDREASKRKIIKGNPTNIFELNEIKYSWAFDLYKLMGFTNFWIPEEIQMLEDRKQYETVLSDYEKRAYELVLSFLIALDSFQVDMLKEFGRMITAPEVEMAITAQEFQESVHAYSYQFILESVVDPVKADEIYNYWREDERLLERNKVIAELYNEFIRKPNEENFIKATIGNYILESLYFYSGFAFFYTLGRQGKMRNTVQQIKYINRDELCFIEGTEVLTKRGFVDFRELREDDLVAQYDIETGEISWTKPYAYVERDYEGSMYRLKHPKSNWEVVATEGHEFIVRNLKTGKERKEPIEKVKLHPYSAIPVAGRYTGEVEEYDLWELVSGKGITLKTRSAVKNKLTPIEKLLIVLQADGTIDSKRNGKFTGFQQLKFFFSKYRKINEFEKILNECAPYGIKWKKYERQDGIAYTVYYPNDLPIKPTKFFDEWVRLDEITEEWIREFVEELVKWDGHIPKDRNKKKVYYYSTKEKRNKDFVQALCALGGMRTVVSRERNPKAKNPVYRIWIYLEDDYINTQTMVKEEFYYKGKVYCVSVPKGNIVVRYKDSVCIAGNCHVTLFRNIINTLRKENPELFTPEIEKWIVEYFKYAVNEEIKWGQYVTQNQILGINDVLIERYIKYLGNLRITQIGFDPIYPEVTENPLKWIDEFRKINNTKTDFFQAKPQTYSKANELKW

SEQ ID NO: 394 - protein, 2857 aa, Acidovorax avenae subsp. citrulli AAC00-1
  Aave Hyp-1721 precursor
MEDQNLKPFDGVLDAPSSGTLQPFSGALDGEEPKRGLKGWGQDIAATAVKGAIAIPEAAVGLADILTGGRVGKFLENEGGAVGFRPKQTREIVNDWHSDATKEAQRKFQEADGIVDKAVTAVQNPSLVVASVGESIPTMIGGGAIGRGLLAATRLGQMGAKGAALAGAAGEGLTMAGSQAEQIRQETPDGLLTPSQAGLAAATGAVGGAVGAVGGRIAQRLGIGDAETMLAQGRSGMARQFADEAAGAAVNPLQQQAVKSIPRHVIEGAIAEGLLEELPQSVAEQIFQNVALDKPWYDQVDSAIVLGALSGGAMGAGAAGYHAAARPRAAAVGEGDPAAARPAGDEPAAEAPARNPGLERVSEAFAEQLRMLQEQEQGEVLGPQSAPPDGAAALAEQRAAAAAQRQADMEASRAVESPDDEIYQSTGAQVPRSVRMGINPADGPLSTGAAMAVDTGVSDQMQQAAALAQAAEAGEKSGKAQKQEQPARSPLGADPETGEIPGSDDVANWSDAQLSEVFRGAQGRDVRIKLAQELSRRKAARAAEQSTPVKGTTDGPQAQPASTQPPAAAQAPAVAAAGAPAQGTLINGGTTTADAGAQAKTAAGAQAAPESKDQRAQRIDAAGQTWTRLPTVQRQVVAEQLKGLKPVLQKNLAGAKWENLNSDLKRKIADLIAPVQEAAAAPAPAPAAPVAMARGTTFPPLDAQPVPAAAEARVPPKAAGTSARAARAAAAPVSAPTVAQAAAQEAATSLSNDLPEPTEAQKLAGNYRKGHARINGHDISIENPAGTRRRPEWPPLQNHYGYIKGTKGADKDHVDVFMTDRAEDSALPVFVVDQVNKDGSFDEHKVVMGAADEAEARSTYLGNYEKGWTGLGGITQMTQDEFKDWVRDPAKTVKPAAAPAAGDALPTAAAEEAGPAPDKDAETAPAPAPALPASESASAAPPAPPAAAETVPQRMKRAKAEKAAAPATPAAAGEASPAAKPKTVPEKMKDAKAKRESKAVREAREAEERRAAYFAPGNVVRGYGGGFDRVVSYQPADADGRWSVTVREVQKDGSGAWADKAGAVERTHGTEPSKVNYATGPAGRMEVDPAPAPAAASHEPSAPARNRDNARKRGPAESEPLFRRYAQDDLGAGMAAELLRIMGKGDGFSPEARLQAVESIRATVSPIVAAWQNAPEVVVAYDLNDPIIPQRVRDADTRQRSGGAHGAPEGFYFGGKAYLMASRLTTPEDAARVLYHEVAGHHGLRGLFGPELDKILNQVATMRRADVDAKMAEYGMRGVDRISRARAAEEVLAEMAEKNPQLSFVQRAVAAIRNFLREHVPGFGSLRLRDADIIQAYILPARNWVERAAAARERGMGSAAMQYSLAQDEARSGFAAEVRAAITAGLNNDERALRAQVPLGIETPAALEALGVVRKPVVTNRNLLAKMHFEHGVPRADLERLGELLSNPVMVFKSDTQPGRMVVVTSLVVRGNPVVVAVDPNGASNRAEVVYVPSAYPKDNADRTFTRWIRDGLLQFANKKESRQLATTARLQLPGVVQRVSGFRANYKTEADLPQTGAGPDVMFSRERIAALKDSALDQITQTMSHPGKVSLWDKTIGTMRHLAERAPAFKPVFESAQRFIDDVSMLGNDAADMAPRLLPRVDSWRDLTKKPITAADNKAVARPLFEGTLMWARDIDGTPVLLDDLTAKYQNLPADQKAQLLLRGGRLDPKILTAWQGLPVGMYEANVNTSFNSRVLKAGVVWSQKELETMFGLDANQVSLYQEGRAAIDRSIDMTARADMLRSLGDEYAGMRDAVLAQETLDDAVELLTRTLMDDARDRPEWSERLMKLNNAVVKAQERAQQLMDEGYAPLSRFGRYTVDVVDAAGDRQYFGMFETKADSNRMKAEMEKQFPGATVTQGTMSQDAFKLFAGVTPESLEMFGSMLGLDGKGDDPKDKAFQAYLQLAKNNHSALKRLIHRKGVAGYSEDVGRVLASFVYSNARLGAGGLNAGTMESAINAIPKEQGELKDLAMGLRDYIANPQEEGQAVRGMLFAQYLGGSVASAAVNMMQPFQITMPWLSQFGGMRKAGAQMARALKDMSRKGFQYEPDLAAAMQSAEEDGVVSPQEIHQLMSQARGTGSLRTGDGTKVGDARAAVANNWERVKVAWGQPFALAEQFNRRSTFIAAYRMAKEQGMAEPSNFARKAVLETQFVYSKANKPRFARGAVGGALFCVDDTTEALTQRGWVGPDHLVPGDMLASFDMTTERLIWAPMASVHIFDHDGEMVHAKSKTLDMLMTPDHRVVHYKRKRTKGAQRGTTHWELGVAEAQDIPASHRVQIPTAAPFDHLPTGEPITDAQARVLGWVVTEGWFTKKNRGREEWGGALKLYQNEGRTADLIRADLDAAGLEYTETTWNYVGGNAAHIRFNIKKSSAAVLRKMLPGKQLTPALLMRMTKAQIELLVDRMIEGDGSESAAGQRCLIQNPGQTLETFQMALTILGKSFRVSKHGPSCRKVLIRESQRTENGRYSVKESERVRYTGRVWCPIVPGTSTWVARRNGMPFITHNTFKTYSVSYLELMHRMWTQGGPEGKRAVGWAIAMLLLMSGAGGLPFMEDAEDLIDGAAQMMGYNLSSKQWRKQLLADVMGKEIADFVEQGVSGLPGAPVDVSGRMGLGNLLPGTGLLLSKQNRERDLLEVAGPAGDLIARGFTAGRKLLTGDAGGAALEVAPTAVRNAVKGVDMAATGIYKDKKGYKVIDTTLAEAGAKFLGFQPKSVAEVQEANSFMQRTKTFYTQTSSEIKAQWADALFRKDDAALAEARERLADWNRNNPEQPIVVKMPDVWKRVREMGKDRTQRIADTAPKALRQQMREAAREAGQAPA

SEQ ID NO: 395 - protein, 1226 aa, Acidovorax avenae subsp. citrulli AAC00-1
  Aave RIR precursor
MQRDPIDSLAPDAAPRLPEQPISLDVLREKYLKPGEADAETLYRRVARALASVEAPEVREAIEARFLANLRAGAIGAGRIMSAAGTAIQATLINCFVQPVGDCIQGMDEGGYPGIYEALREAAETMRRGGGVGYDFSRIRPRGAEVKGTASMASGPCSYINVFDQSCATVESAGARRGAQMGVLRIDHPDVLDFITAKRTPGRWNNFNVSVGVPDAFVQAVLDDAPWELVHPARPGAALREEGARQRADGQWVYRTLPARELWDTIMRSAYDFAEPGILFLDRVNTDNNLAYCESIAATNPCVTADTWVMTDAGPAQVADLVGRPFTAIVDGRAFPTLSAGFFATGHKPVLRLRTRQGHALRLTEDHLVRRVAKQTRYVRELEWVAAGALQPGDDIVLNDHRALPGWRGEGTGAEGYLLGLLIGDGTLKADKAVISVWLAQEQEEDALLVANGAPAPSSGAHGILRAAEAAAATLSHRADFRGFQRTVARSGGACAERRMASGAVRALALHMGMRPGAKTITAAMERASSAFSVGLLRGLFDTDGSVQGRQDKGVSVRLAQSNPALLQTVQRMLLRLGIASTLYPDRRTAGLRLLPDGRGGQEPYAIRAQHELVVSGDNLRVFAERIGFEDADKAERLATALSGYRRALNREPFTATVQDVLPDGHEDVYDVTVADCHAFDANGLCVHNCGEQPLPSYGCCDLGPIILPRFVRHPFGFAGEPAFDFDAFAASVATQVRALDNVLDVTFWPLPQQRAESAAKRRIGVGFTGLGNTLAMLRLRYDTDAGRAMAMRIAECMRDAAYAASVELAKEKGVFPKFDAAGYLAPGTFASRLPAALQEAIRTHGIRNSHLLSIAPTGTVSLAFADNASNGIEPPFSWTYTRRKREADGSTSEYAVEDHAWRLYGALGGDVNALPDYFVSALQMPAAGHIAMMEAVQPFIDTAISKTVNMPADYPYEDFKNLYLHAWRARLKGLATYRPNAILGAVLEAPAAAPEAGTATTSAAHDASESADRPAVQSSAMPPATPADPMRAVIESRPKGALSAVAEKVEYWTQEGRKTLYLIVSFLPVPDGHGGTVDRAIEFFMPVGQSGESQQWITSSMRLLSLAARGGFLERALSDMRKVAWDRGPVRLGTHTRADGARVPLWHDSEVAAIAYAIQNILAQRAAAPAGPMRQQELPLDAPAAPTGLPPAMAGRKCPECGAHAVIRKDGCDYCTQCGNLGSCG

SEQ ID NO: 396 - protein, 227 aa, Aspergillus brevipes FRR2439
  Abr PRP8 precursor
FWWTSQRHDGKLWNLNAYRTDVIQALGGVETILEHTLFKATAFPSWEGLFWERACLAKGTRLLRYDGTEIEVQDVKEGDLLLGPDGGPRRAFNIVNGEDRLYRIKIDEGIEDLVVTPNHILVLHREKKARNNEDEASAAERYDTVEMTAAEFAALSTEERSQYRAFRCPGFESPEKAVPENHSFMIQDIRLELETTEWAGFRVDKDQLYLRHDYLVLHNSGFEESMK

SEQ ID NO: 397 - protein, 1098 aa, Acidothermus cellulolyticus 11B
  Ace RIR1 precursor
MTEPTSGARAQMDGSGRRGLTMQRIYTTPGVHPYDEVNWVRRDVVMTNWRDGSVNFEQRGVEFPDFWSQNAVNIVTTKYFRGALGTPQREWSLKQLVDRVVKAYAKAGLENGYFATPDDATIFEHELAHALVHQVFSFNSPVWFNVGTPAKQQVSACQPYSAPVSTPDGPIPIGKLVDANAVGEKVFDASGVTRIVATTCNGRKPVLRIRTSGGHVLDVTPDHLVWQVVDQTAGRFVPAGQLRVGDRLEWHDRANSDAMVAAFTADSAAAAQPGQIVDILAIDELGVMPVYDIQTESGEYLSDGIRVHNCFILSVDDTMESILDWYKEEGLIFKGGSGAGVNLSRIRSSKELLSSGGTASGPVSFMRGADASAGTIKSGGATRRAAKMVILDVDHPDIEEFIETKVREEEKIRVLRDAGFDMDLGGRDLYSVQYQNANNSVRVSDEFMRAVERGESFGLRARTTGEVIETVDARKLFRKMAEAAWACADPGIQYDDTINDWHTCPESGRITASNPCSEYMHLDNSSCNLASLNLMKFLTDDGRFDIDTFIKVVELVITAMDISICFADFPTEKIADTTRRFRQLGIGYANLGALLMATGHAYDSDGGRALAAAITSLMTATAYKRSAELAAIVGPYDGYARNAEAHKRVMRKHAAASDALRTIGEMDRAIAERACQMWRECLTLGEQHGWRNSQASVLAPTGTIGLAMDCDTTGIEPDLALVKFKKLVGGGSMQIVNRTVPRALRTLGYPEEQVEAIVEYISEHGSVVGAPGLRPEHYEVFDCAMGDRAISPMGHVRMMAAVQPFISGAISKTVNMPESATVEDVEEIYFQGWKLGLKALAIYRNNCKVGQPLSDAKEKKVSAAVEGSHEHRPVRRRLPKRRPSQTISFSVGGAEGYLTAGSYPDNGLGEVFLKLGKQGSTLAGVMDAFAIAISIALQYGVPLEAFVSKFVNMRFEPSGMTDDPDIRFASSIMDYIFRRLALDYLPYEKREELGIFSAEERARKQSGELSAASAEPLADETADSVTADDAEARADTAVAGSAPRATTPGLGGHGAAELVDRVFGQAADAPLCMNCGTTMRPAGSCYVCEGCGSTSGCS

SEQ ID NO: 398 - protein, 1381 aa, Alkalilimnicola ehrlichei MLHE-1
  Aeh DnaB-1 precursor
MAQTESSSAATDALKVPPHSIEAEQAVLGGLMLDNNAWDQVADRVTEEDFYRRDHRLIWRAIATLADEGQPVDAVTISEWLKNHELLEAAGGMGYLGALASDTPSAANIKAYADIVRERSVMRQLIRVGTDVVDSAFQPEGRDSKTLLDEAERRIFQIAEQTGRHKQGFRGLKELLPGVVERIDQLYRQDGEVTGLATGFDDFDRMTSGLQNGDLVIVAGRPSMGKCIMAGSRLVDPRTGGRVTIDELVARQEAEVLTLGDDFRLGMARPAAFVDDGIKPVYRVRTASGREIATTLTHPFLTGDGWRPLSEIGVGEHVAVPRRIPVFGRERLPEHQVKLLAYFLGDGGTTQTSPLFTNADERVRGDFTDAVTAMGGVRCVPVGSPGRTPSLRVSRCRTALQSGRDVFAKALKGAMQQLQLTGEALADALGVSKAAVSGWINARTVPAPATYQRLCATLASSGQALPGTDYADIGKNSPNPVAAFLDRHRLWGRLATEKAVPEVVFRLKRGQLALFLSRLFACDGSAFVQGNGQARISYATSSRALARDVQHLLLRFGILSKLREKRNRYPGLQHAPWELEVMDQASLRAFCEEIGIFSKEEQVRGVREALAGKRRHNNVGGLPWSVSRYVLAAKGERSWGDIYQAAGRVLPEGFNAHLTGRSARRLSRHRASELADLLQDDYLARLATSDLHWDEIVEIEYIGAHQVYDLTVDGTHNFVAEDVCVHNTTWAMNIVEHAAMKQEAPTAVFSMEMPGDSLAMRMLSSLGRVELQRIRSGRLEDDDWPRLTSTLSLLSQAKLFIDDTPGLSPSEMRARARRLKREHGLGLIVIDYLQLMQLPGAKENRAQELSEISRSLKGLAKELDVPVIALSQLNRSLEQRPNKRPVMSDLRECVTGDTRVLLADGQRVPIRDLVGQTPEVISVNAEGRLEPAKTDLVWSVGVRPLLQVRLASGRTIRCTPEHRLRGLWDWKEARDIRVGDRLGIARELPAPKVTKRWAEHELVLLAHLVGDGSYIKGQPLRYTTASEANSEAVSRAAEAMGSTVTRHPGRGQWHQLVISGNGNRWHPQGVGKWLKQLGVFGQRSREKHLPQEVFQLDNDQLALFLRHLWATDGSITQGSAGRPRIYFSTASRHLIQDVAALLLRFGIVGRTKHITHGDGEGWFTLDISGAVQQQRYLEKIGAFGHQAHNARRALQHLRGLVENTNVDTLPEEVFNYIRERMREEGITHRQMAALRGTAYGGSAHFTFSPSRETLLSYADILNDQRLRMLANQHVFWDRVVSVEPAGEEEVFDLTVPGNACWLADGIVSHNSGAIEQDADVIVFIYRDEVYNPDTPEKGVAEIIIGKQRNGPIGTVKLTFLGRFTRFENHIEEYYPGGGLPE

SEQ ID NO: 399 - protein, 1381 aa, Alkalilimnicola ehrlichei MLHE-1; identical to SEQ ID NO: 398
  Aeh DnaB-2 precursor

SEQ ID NO: 400 - protein, 1095 aa, Alkalilimnicola ehrlichei MLHE-1
  Aeh Rir1 precursor
MTTAAKVRALPNATADIPLQSASADIWDKKYRLKSKDGQVIDETVDHTWQRVARALAEVEKTKKLREHWYERFLWALRRGAIPAGRITSNAGAWAHKPATSTINCTVSGTIQDSMDDILQKVHEAGLTLKAGCGIGYEFSTLRPRGAYVSGAGAYTSGSLSFMDIYDRMCFTVSSAGGRRGAQMATFDVGHPDVLDFIRAKREDGRLRQFNLSLLITEEFMQAVEDDAQWPLAFPLTKHEAETDNIDLTDSEQVIWREWPTTEPYISDEQGLVACRIYRTVKARRLWDMIMTSTYDFAEPGFILIDRVNEMNNNWFCEDIRATNPCVTADTWVQTADGPRRVAALVGRRFSARVDGTDHPSGDEGFFRTATKEVVELRTAEGYRLKLTADHRVRRVSAFTRYRTETEWCEAGQLQAGDRVLLNDHRTNAEWAGRHGRNEGYLMGLLLGDGTLKSDKAVLSVWRTAAAANGVPAGLPGGVEEVMAEGLEAARSLPHRADFTGWCEVPGRGEYRLATSAIRDLALELGIRPGSKRITDGVEQGSSDFYKGFLRGLYDADGSVQGSQRKGVSVRLAQSDSDNLEAAQRMLLRLGIASTLYRDRRPAGNTVLPDGNGGSAEYATRAQHELVISGENLARFRDLIGFANSDKQARLEALLDRYQRTLNRERFVARVVAVEAAGTEEVYDVQVPGINTFDANGLHAHNCGEQPLPPYGACLLGSVNLTKFVRDPFTEKARFDWQEYAEVVSVFTRMLDNVVEINGLPLDEQRREIERKRRHGMGFLGLGSTLTMLRMKYGEAESLAFTEKVSREMALAGWRTGVELAEEKGPAPIMDETYTVDEAMLAKRPEMAVDGYKVGDKVKGRVLLARYSHYMQRVAEVDAELVEAIAEKGARFSHHTSIAPTGTISLSLANNASNGIEPSFAHHYFRNVIREGRKSKEKVDVFSFELLAYRHFIDPEAVPSTDPETRNLPDYFITADSVTPKQHVDIQAAAQKWVDSSISKTANVPTDYPYEDFKDIYRYAYQQGLKGCTTFRFNPEAFQGVLVTEKDLTNTFYKFKLADGTEVELRGDEEVEYDGETHTAANLYDALKEGYYGKF

SEQ ID NO: 401 - protein, 993 aa, Acyrthosiphon pisum secondary endosymbiot phage 1
  AP-APSE1 dpol precursor
MQNLLFCDLETYSDIPINCGTHRYAENAEILLFAYAYNHAPVKVWDVTQDKTMPADLKAYLDDSEILTVWHNGGMFDTVILKRVLNIDLPLSRVHDTLVQALAHGLPGALGLLCDIFNVNSDKAKDKEGKALISLLCKPRPKNSKIQRATALTHAEEWQRFKDYAGSDILAMREIYQHLPNWNMNVHETELWQLDQKINRRGMCMDVELAKSALTAVENEQKRLSTVTQQLTDNAVQNATQRDALLQHIASAFGITLPDMQASTLQRRINDPDIPPALRELLSVRLQSCTTSTSKYKALLKSVSADGRLRGTKQFCGASRTGRWAGRVFQPDNLPRPTLDPNTIDNGIEALKAGCAELICDDIMQLTSSALRGCIIAPPGKKLVISDLSNIEGRMLAWLAGENWKVNAFSEFDNGKGDDLYKLAYARAFNLLPEDVTKEQRQIGKVMELGLGYGGGVAAFLTFALAYGLDLDELAEAALPNIPPGVKREAMRWYQKSVETDKTYGLSEKIFVTCDSLKRMWRNAHPQTVSFWYDIEDAVKQAIQSPGIAFKCRKLSVRRDKSWLRICLPSGRSLCYPSARIENGQITYMGTNPYSRKWERLKTYGGKSCLAKGTLVLTITGWMPIEIVSQDAYVWDGIEWVRTDGSVFNGNQEVIQAYGVGMTADHQVLTEKGWKSASQSKRYNRSSCRLPDGYKLPRFRRKEINLESTLHLWTRNNHSSNRITKTKKTRYNCLLRMPKGTNNIMQKPKARNVKTPRFCCMEQHVSQMYSPFPQSMVKLWWSGNNGLQTLAKKFQQFLGRHGQDIPTRLIFRSHQQQCRLPPQKLPLGYVASTSSKYSTSTIRANSPRHNEYTGISSPNRDCSKHALLSPGKKGKSSTTSGAPKHIAEVYDLINCGPRNRFVIATPDGPLIVHNCENICQAAARDVLAYNMPPIEKAGYEIVLTVHDEIISEAPDTPQFSAEGLSKLLSFNSDWAWDLPLSANGFETYRYRKE

SEQ ID NO: 402 - protein, 726 aa, Aeropyrum pernix K1
  Ape APE0745 precursor
MVRVERLRTGVEGFDPLVAGGIPRGFFVAVVGEPGTGKTVFSIHFAYQGVREGDKVIYVTTEESRESVLKQAAMFGMDLGRAVDEGRAIVIDALLKSRSDEWSLEDVSVESLVNKVLEAKRALGYGRARLVVDSMSAFWLDKPAMARKYSYMVKRVLYRWDFTTLLVSQYAITTQSLPPWEPIVVRRGDEVRVTSIGEFVDSFLEGEGGLDIGGLGYYTLSLDTRTLKPVWRRIRGVIKHRIRGRLLRVKASKGRSIDLTGSHSIYRISRGGGLEVVGSSDLRPGDSLVTPASVELPESAPSSINAARELWSRGVEGIFVVGLPGEAAGYRGVERSRGYDGGHAIPLETLVERYGDSVWSLVSGAKLAVSRGAAGDHPVPATIPLDTGFYLLLGFIVSAGSVDVEGGHVTVTLGPGREGYVGDVVEAVNSTAPGAGVRISSGARGMEVTIRSRVLSELLARVFGAGPGPNRDIPSIVFRAPKPMKRVFLKGLYAGGGVFDRSSGSLIYATDSRSLLNGLALLLLNVGAGGYRIDSGDSGRALALIVENAGRLDAIGEVLEHLGFHGGREAVQGVGALERATAGLAGQATVAVQRPATRGGPGVDVAGVTGLEHLEASTEFVYDLSVEGDENFFAGLGWILVHNSAFGWGLEHVADGIIRFRRRIVGGALRRYVVVEKMRQTPHDLRVHRVEIEDGRGMRIAGPLEARPEDLRMPEDLRRRLKGGGP

SEQ ID NO: 403 - protein, 1740 aa, Acanthomoeba polyphaga Mimivirus
  APMV Pol precursor
MPSETIDSTKQFEFQISDWNSYHELDQEEEEKYVIQLFGRTEDDHDVCLKVTGYTPFFYVEIPKQWKQRQVDKFVEILKNKVQYHCKKNLDEDFDLSKSLIKYAMVKKHKFYNFRNKQLYNFLLLVFKSHTAMKEFSSILARPLEAKGLTNKPMLYQRYESNIEPHIRFMHINNLSSCGWASIDKDKLKKIPEYSNCDYSFSVNWKDVKPSNNDDRMAPFKIMGYDIECVSCDQNFPQAERPSDKIIQIGITMYRYGSMKCYEQHILTLKKCAPIEGVNVECYKKEKGLLRGFAKKIAELRPDFKTGYNNFGFDDKYIYDRILRIDKREGKKQGVNINALKNKFMDEILRTIGKVNNNYLIENEGLDRIPIYTTVKDKKISSKASRFIQIRGGTYVENGNNLKYVQSPGITYFEVKNLSSSALGDNELKFIQIPGVLSIDMMKVIQRDHRLIGYKLDNVSANFITEKADKIIEMPHNQEDSDSEKEDEDTDDKTYDVNIYTKSTKALEKDSYIQIMVNDGYSSSPLSEGAKYKVYDIQTITEKKLNEKTNKEEIFVYQAIKTKICQKDIQQLRETIKNPLLGISWTFAKDDMHHTKINEYFEEGDPKKIRQIAKYCLKDCKLVNLLLAKLEIIVNSVGMAKVCHVPLSYLFLRGQGVKIFSLVSKKCREKNFLIPVLRRKSKDNEGDEDETYEGATVITPKPNVYLSPIGVLDYSSLYPNSMRERNLSQECYVDDSKYDNLPGYIYHDVEIILKDKKGKILRNIDGTPQKEYHRFAQEIITDEQINRELKDIFDKINTVFENNVAIIQNQKYFTEKNISELIDKHKNISDSKIEDIEFDESLSDKRKNKLVDAEKDSLDKNIGFYQKIKSQIDKIKLDSKIEIDNLSKNLNEEEKSKQINKMELNTKNLISKVFSKYLITEQQREELIVLEKERAKRSVNAEKAKVYNTVDGITVRYGILPEILTELLNKRKETNGKLANEKDPFVKAILNALQLAFKVTANSLYGQTGAPTSPLYFIAIAACTTAIGRERLHYAKKTVEDNFPGSEVIYGDSVTGDTPIITRHQNGDINITTIEELGSKWKPYEIFKAHEKNSNRKFKQQSQYPTDSEVWTAKGWAKIKRVIRHKTVKKIYRVLTHTGCIDVTEDHSLLDPNQNIIKPINCQIGTELLHGFPESNNVYDNISEQEAYVWGFFMGDGSCGSYQTKNGIKYSWALNNQDLDVLNKCKKYLEETENIQFKILDTMKSSSVYKLVPIRKIKYMVNKYRKIFYDNKKYKLVPKEILNSTKDIKNSFLEGYYAADGSRKETENMGCRRCDIKGKISAQCLFYLLKSLGYNVSINIRSDKNQIYRLTFSNKKQRKNPIAIKKIQLMNETSNDHDGDYVYDLETESGSFHAGVGEMIVKNTDSIFINFHIKDENGEEKTDKEALMKTIAKCQRAAKLINQNVPKPQSIVYEKTLHPFILVAKKKYVGLLFEKSPDKYFLKSMGIVLKRRDNAPIVKIVVGGIIDNILKNRDIDKAIEYTKIVLDKLMNGEYPMDKFIISKTLKSRYKKPSTIAHKVLADRMAVRDPGNKPQINDRIPFVYIVKDMGKKKKKDILQGDLIEHPEYVIANNLKIDYLYYLEHQIINPASQILELMMDTKDVQKFFNKYIIDEQNKRKGAQSLTKWMDFSKLPKESGSKTAKKPYQSQKLQKTKSSNKSQIDPKYINLIKNKSRKHECQNMNKWISSTDKCTDDWEPIVE

SEQ ID NO: 404 - protein, 807 aa, Burkholderia cenocepacia
  Bce DnaB precursor
MNAPQDPQIESLKVPPHSVEAEQSVLGGLLLDNAAWDRIADFLSQGDFYRYDHRIIYEHIGRLIASTRPADVVTVYEALTTSGKADDVGGLAYLNALAQNTPSAANIRRYAEIVRDRAVLRRLVSVADEISADAFNPQGKEVRQLLDEAESKVFSIAEEGARGNQGFLEIGPLLTQVVERIDTLYHTANPSDVTGTPTGFVDLDRMTSGMHGGELIIVAGRPSMGKAQPLDARVRTLTGWKPMGELTVGDALASVDGAPSIVTGIYPQGERQVYRVRFSDGRSAECCDEHLWCVHFREWEKPRVLSTAEIRTLLTRERYRNRLWIDMPSGEFGHREVLPVDPWVLGALLGDGALGGTAVRFSVKAEETLNRMRERVDASLELEYAGQYDWRIKRRPSTATAARPSANPLKAALEQLGVWGRTSYDKFIPRLYLDADKDTRLDVLRGLLDADGWVESWGTVRYSTASAQLASDVRELARSLGAWCQVAEKATSFTVDGERKAGATAYICTISHPDPQNLFLFEGKRERLTAGRTRRKLPVITGIEPSRRTATQCISVSHPSRLYVTDDYVVTHNTAFSMNIGEYVAVEYGLPVAVFSMEMPGTQLVMRMLGSIGRLDQHRMRTGRLTDEDWPKLTHAVQKMSEAQLFIDETGGLNPMELRSRARRLARQCGKLGLIIVDYLQLMSGSSQGENRATEISEISRSLKSLAKELDVPVIALSQLNRGLEQRPNKRPVMSDLRESGAIEQDADVILFIYRDEVYNPDSPDKGTAEIIIGKQRNGPIGPVRLTFLGQYTKFDNFAGAQTFYGE

SEQ ID NO: 405 - protein, 1202 aa, Batrachochytrium dendrobatidis JEL197
  Bde-JEL197 RPB2 precursor
KKRLDLAGPLLGGLFRMLFRKLTKDVSRYLQITMESGREFNLSLAVKSSTITNGPKYSLATGNWGDQKKFMQARAGVSQVLNRYTFASTLSHLRRLNTPIGRDGKLAKPRQLHNTHWGMVCLSGDTEVVLGNGMDVVLLTDLVDGACVSTIEPRTGVVSPSLIDHYFAKDATRVLKITLDDGRVIKADPEHPLFAAKVDETTRGLTGQWLRVEELTVGHHALLVSPQQAYCTSEQWTLTLSEKEVCTASTAQLAKQLSEIGLVGVPIPLSKVKSAARLFGLVLSAGDFSGKLYVEKDEDVTAVNSDLTALGFSPAHWVRYQDDQQKWFKCDDSNGKAICITLVPTANALLQTLGAHDAEKQHRYCLLPKWLLDAPTSIKREFLGALFGGNGAHITISCNEGKWEPTMSALTQHTDADHLESTVVYLKQVATLLGMLNICSSVSSEKHITAEKTGYAVHLHVDNTAENLVRFYEQVGYRYCFNKTSQSSAPVQWIKGSLFFIEQHRSKCQHAFELLHTGLGTKAAVSAEINMPHHNPSHMLNVKEIPTAPADEYITWIEFKDRYVHKESPRFVWVTIHSIEEAPAERLYDFNTVSQNHSFFANSIVSHNCPAETPEGQACGLVKNLSLMGYITVGSPAPPILEFLEEWTMESLEEISPSTIPTATKIFLNGQWVGIHRDPDQLVSTLRRLRRSVDVSPEVSVVRDVRDRELRLCTDAGRIARSLFVVTPEQSLVLTKEMVQQLHEDQIQWKDLLSYGVVEYIDTEEEETVMICMTPDDLAEARMAAAGQVVERHQVGTGRLKSATVYTRNYTHCEIHPSMILGICASIIPFPDHNQSPRSVYQSAMGKQAMGLFLTNFQLRMDTMSNILFYPQKPLATTRAMEFMHFRDLPAGINAVVAIACYSGYNQEDSLIMNQSSIDRGLFRSLYYRVYMDQEKKVGMISTETLEKPSRDTTLRLKHGTYEKLEDDGLIAPGVRVSGEDIIIGKTVPIAADSTELGQRTTMHTKRDASTPLKSTENGIVDQVLITTNQDGFKFVKVRVRSIRIPHMGDKFASRHGQKGTVGITYRTEDMPFTADGITPDLIINPHAIPSRMTIGHLVECLLSKVSTFTGDEGDATPFTDVTVEAISQALQGYGYQRRGFEVLYNGHTGRKLNAQVYTGPTYYQRLKHMVDDKIHSRARGPLQILTRQPVEGRSRDGGLRF

SEQ ID NO: 406 - protein, 474 aa, B.subtilis M1918 (prophage)
  BsuP-M1918 RIR1 precursor
ESGYPYIMFADNVNKVHPNEHISKVKFSNLCVTGETLLLTENGYEKAADLYKKQNNLKVVIDNRTKDFAVDSKGTTIVDAIPMQLTKKDAEIFKVKTKQGYEIRATEWHKFYVKRDGEIQKLQLNQLKTGDKLLVQSAEGAYGKIHEPDLAYIMGIIAGDGTITEKTAKIYLYDNKKVLEQKVTDAVHRIIHKHKVDRAYKHNTSLLPTFNMANPEKQDLLYMNSTVLFDILKKFGMNKERKTRVPEFIFQANKETQAAYLSGLFQTDGCVNANHKAKALTIELTSIHYESLQDVQKLLLNMGVYTTIYSNNKRSQELLPDGKGGSKLYNVKPTHKISIQDRNSRELFMSIVELKDYDVYKFNLLTETLQPKSRKPKHDFTAEIISIEEDGVEDVYDTTQEDYHSLIFNGIVTGNCSEVLQSSQVSVYTDYDKEDEIGLDISCNLGSMNIVNVMSNQSIASTVRIAIDSLTTVT

SEQ ID NO: 407 - protein, 1084 aa, B.subtilis strain 168 Sp beta c2 prophage
  BsuP-SPBc2 RIR1 precursor
MTNTIPNWIKLNNEIMIQKDGKYQFEKDKEAVHSYFVDYINQNTVFFHDLKEKLDYLIKNDYYEEEFLSKYTFEQIKSIYKIAYSYKFRFPSFMSAFKFYNDYALKTNDKTKILERYEDRVSIVALYCADGDYEKAVEEVHTMMKQEYQPATPTFLNAGRKRRGEMVSCFLLEVGDSLNDISRAIDISMQLSKLGGGVALNLNKLRAKGEAIKDVENATKGVVGVMKLLDNAFRYADQMGQRQGSGAVYLSVFHPDITDFLDTKKISADEDVRVKTLSIGVVVPDKFIELAREDKDYYMFYPHSVYKEYGQYLDELDINEMYDELVENPRVRKAKGNARKLLEQLAILRSESGYPYIMFADNVNKVHPNEHISKVKFSNLCVTGETLLLTENGYEKAADLYKKQNDLKVVIDNRTKDFAVGSKGTTIVDAIPMQLTKKDAEIFKVKTKQGYEIRATEWHKFYVKRDGEIQKLQLNQLKTGDKLLVQSAEGAYGKIHEPDLAYIMGIIAGDGTITEKTAKIYLYDNKKVLEQKVTDAVHRIIQKHKVDRAYKHNTSLLPTFNMANPEKQDLLYMNSTVLFDILKKFGMNKETKTRVPEFIFQANKETQAAYLSGLFQTDGCVNANHKAKALTIELTSIHYESLQDVQKLLLNMGVYTTIYSNNKRSQELLPDGKGGSKLYNVKPTHKISIQDRNSRELFMSIVEMKEYDVYKFNLLTETLQPKSRKPKHDFTAEIISIEEDGVEDVYDTTQEDYHSLIFNGIVTGNCSEVLQSSQVSVYTDYDKEDEIGLDISCNLGSMNIVNVMSNQSIASTVRIAIDSLTTVTRKTNIVNAPAVARANTLMRSIGLGQMNLHGFLAQNNIAYESEEAKDFANTYFMMVNFYSLQRSMEIARETGETYYKFDGSTYKSGEYFEKYVTNDYSPQYEKVKKLFGDQHIPNIQDWMKLKEDVMKYGLYHSYRQAIAPTGSISYVQSSTAGVMPIMERIEERTYGNSKTYYPMPGLSAQNWFFYKEAYDMDMFKVVDLIATIQQHVDQGISFTLFLKDTMTTRDLNRIDLYAHHRGIKTLYYARTKDTTQEGCLSCVV

SEQ ID NO: 408 - protein, 978 aa, Clostridium botulinum phage C-St
  CbP-C-St RNR precursor
MNIEITLNKGFETKLEELRAKYGEDMFEIEGLGKKQLNTTLFFDKFMNSNNVANASIDDNSNVSDKNITIMLSESKKPLNKLLSRNKLYIEMKENFGKQVADEWLELQINGALYEHDAHDSSLKPYCYAYSLKPVVDKGLYFINDMKAKPAEHLDTYDSHVLEFIAYATNLQSGAVGIPDYLIYAFYFWKKDIENGVVTKEQANKYREQHWQKMLFSLNQPYLKGGEQSAYTNFSILDREHILGFFGMEKFPDNTLIIDYIDEIIQYQKDFLDYEKKLRYEKFFTFPVISASLLYKNDKFVDEDMARFINKHNMTWQDVNIYKATSIDALASCCFDGQQKTLTKSSHGVNYLSFKDLYDTKYKDKERRNFKVFHNGNWVEGKPIRLLRNDKKMYKITTVNNKEILVTEDHINVTDKGDKYTTQLTENDYIAFNTRPTNAIPEKDEKLTYEQGVLIGAYLGDGSKQRNEHKIQLSINEEKYNILRPLIEKALKQWNIQAQYRLYTPHNNFYPTAITSEDLLNIIEHWVKGDYSYNKRLNLEILHQSIEFRKGVLDGIYFTDGGNSNRIYTTSDSLKEDLEILIHSLGMVSIINTTDRTDEKVIIRGEEFNRNQKGLYKVINNTMFFKIKTIQQYISNDEYVYCFEMKNIEEPYFTLPNGIITHNCRLTSSSKEISENKEVAELNGHFNSIGGSSLSIGSCKVNTINMVRIALECNGDFNKFKDILKHRVDISHKYLKVQRDVIAKNIKKNLLPVYSHGLMDMNNQFSTIGINGMFEAIKILGGIETTSTGVHYTDRGLSMAKDILETIGEMNKVTRKQYGYNANIEQIPAESASVKLCKKDKILFGDRVNTYIYGNQWIPLNVQADLTERVRVASVLDKACGGGVMLHINLGERFKDEEQSWRMMNYLAKQGVVYFSFIMKINVCENDHSFYGDMCPICHKPVSDSYVKIVGYLVKQSSYKSERAKEMDERKFYSNYNI

SEQ ID NO: 409 - protein, 978 aa, Clostridium botulinum phage D
  CbP-D RNR precursor
MNIEITLNKGFETKLEELRAKYGEDMFEIEGLGKKQLNTTLFFDKFMNSNNVANASIDDNSNVSDKNMTIMINESRKPLNKLLSRNKLYIEMKENFGKQVADEWLELQINGALYEHDAHDSSLKPYCYAYSLKNVVDKGLYFIKDMKAKPAEHLDTYDSHVLEFIAYTTNLQSGAVGIPDYLIYAFYFWKKDIENGVVTKEQANKYREQHWQKMLFSLNQPYLKGGEQSAYTNFSILDREHILGFFGMEKFPDNTLIIDYIDEIIQYQKDFLDYERKLRYEKFFTYPVMSASLLYKNDKFVDEDMARFINKHNMTWQDVNIYKATSIDALASCCFDGQQKTLTKSSHGVNYLSFKDLYDTKYKDKERRNFKVFHNGNWVEGKPIRLLRNDKKMYKITTVNNKELLVTEDHINVTDKGDKYTTQLTENDYIAFNTRPTNAIPEKDEKLTYEQGVLIGAYLGDGSKQRNEHKIQLSINEEKYNILRPLIEKALKQWNIQAQYKLYTPHNNAYPTAIISEDLLNTIEHWVKGDYSYNKRLNLEILHQSIEFRKGVLDGIYFTDGGNSNRIYTTSDSLKEDLEILINSLGMVSIINTTDGTDEKMIIRSEEFNRNQKGLYKVINNTMFFKIKTIQQYISNDEYVYCFEMKNIEEPYFTLPNGVITHNCRLTSSSKEISENKEVAELNGHFNSIGGSSLSIGSCKVNTINMVRIALECNGDFNKFKDILKHRVDISHKYLKVQRDVIAKNIKKNLLPLYSHGLMDMNNQFSTIGINGMFEAIKILGGIETTSTGVHYTDRGLSMAKDILETIGEMNKVTRKQYGYNANIEQIPAESASVKLCKKDKILFGDRVNTYIYGNQWIPLNVQADLTERVRVASVLDKACGGGVMLHINLGERFKDEEQSWRMMNYLAKQGVVYFSFIMKINVCENDHSFYGDMCPICHKPVSDSYVKIVGYLVKQSSYKSERAKEMDERKFYSNYNI

SEQ ID NO: 410 - protein, 610 aa, Coxiella burnetii
  Cbu DnaB precursor
MPPRQKVKTSVPKVPPHSQEAEQSVLGALMLDNRAWDRIADRISIQDFYRSDHQLIFETMSRLVDQHKPLDVLTIAEALKAREQLSAAGGEPYLYELAKNTPSAANIVAYADIVRERAILRQLIEAGTDITHDGFNPDGRDIKELLDTAEQRVFHIAESRVRGSGPIAIGPLLTKATDRIDKLFHSKQAITGLSSGFTDLDKLTSGLQDGDLIVVAGRPSMGKTVFAINIAEVAAIKGNIPVLVFSMEMPAESLVMRMLSSLGSIDQHKVRTGQLKDDDWPRITHAIEMLSETKLFIDDTPALTPSEIRSRARRLAREHGGLGLIVIDYLQLMHVPGTKENRSTEISEISRSLKALAKELNVPVVALSQLNRSLEARVDKRPVMSDLRECVTGDTLICLADGRRVPIQDLVGHSPEVIAVDDKGRLVCAKSEVIWKVGERSVFEIKLASGRSIKATAEHRLLAFKGWRHVKDFKVGDRLAIAHQVPEPDRLLQHCQSDLFWDRIVSIEEKGSEEVYDLTVPKYASWLADGVVSHNSGAIEQDADLIAFIYRDEVYHEDSPDKGKAEIIIAKHRNGPIGKVILTFRGQYTRFDNFSHESVPQRMPFGGVPV

SEQ ID NO: 411 - protein, 1513 aa, Chlorobium chlorochromatii CaD3
  Cch RIR1 precursor
MKIERLFTQAGNNVFDAFEYSLRSSVLRNTDGSVVFEMNDIEVPVQWSQVATDILAQKYFRKTGVQQRDAEGNVLLDSEGNPLLGSERSLKQVVHRLAGCWREWGEKHGYFDTPDDAQAFYDEVAFMILAQMGAPNSPQWFNTGLNFAYGTTGPAQGHFYVDPATGEVTESGDAYSRPQAHACFIQSVNDDLVNDGGIFDLAIREARVFKFGSGSGTNYSSLRSSGEKLSGGGSSSGLMSFLKIFDSAAGAIKSGGTTRRAAKMVIVDIDHPDVEKFIEWKAKEEDKVASLVAGSRICSRFLQAIVEEALANGADRKTNPRLQQLIQNALSRGVPMSYVIRVLALVEQGYTSLDFNEYDTHYESEAYQTVGGQNSNNTVRVTNAFMLAVANDEVWELRQRTTGKVSRVVKARELWEKILLSAWKCADPGLQFDTTINEWHTCPQSGRINASNPCVTADTLIATDRGLERIGNIVGESRGIKSIDGKLHWVENIFPTGTKPVYQLRTKSGYQLKLTGDHVVFTENRGDVKACELRKDDMVRLVGAPFGKETTGSTDIAQLIGLLTGDGCITTANEIAASGEQRRTAFLTVSKAEQEIAEWANQFINTLRPELGEHNKSGSVTETATTARVAVGSPRILKQFEAFAVLDKGSVHKLFTDKVFQLAQSEQAALLRGLFTADGTVANYSDKSQYIALDATSLELLQQVQLLLFNFGIKSKIYENRRVGELVSLLPDGKGGIKEYPVQQMHSLRISRSSRILFEQQIGFMAESKKYEALAELNRTVSTYRDSAYDAVASLTYSGEEAVFDLTEPETDHFIANGIGVHNCSEYMFLDDTACNLASLNLIHFVDEASGTIKINELRHAASLWTVVLEISVLMAHFPSQTIARLSYDFRTLGLGFANLGTVLMVLGIPYDSAEALAMAGAIASLMTGQAYVTSAEMARDLGTFKRYSDNANDMLRVMRNHRRAAQNAATTDYEGLSVIPHGINAAHCQTALAEAAGAVWNEVLQKGEAHGFRNAQVSVIAPTGTIGLVMDCDTTGIEPEFAIVKFKKLAGGGYFKIVNQSVHKALLRLGYSAEQIEDIERYCKGHGTLEGCPAINGEWLKCKGFTEEKIAAVESQLATVFDIRFAFNKWILGEEFCASLGFSEEQLDNPDFDMLLELGATTAEAAAANDYICGTMMIEGAPHLQPEHLAVFDCASKCGKKGKRYIRHQAHINMMAAVQPFISGAISKTVNMPATATTAEIGNVYRDAWQQMVKAVTIYRDGSKLSQPLNSSSYNDLDEVIMLGTEETLDETKGPQEVQERIIERVYYRSERRMLPKRRKGYIREAYVGGHKVFLRTGEYDDGTLGEIFIDMYKEGASFKGLLNCFAVLASKALQYGMPLEELVDSFTFTRFDPAGTVQGHNVIKNSTSILDYVFRSIGYDYLGRKDFVHVKAVDEVPEGTLVPAEQKKASHHSAANHSTDGAGVVSNKSQIYQAKVQGYTGEQCENCGSMHVKQNGTCKVCEDCGMTTGCS

SEQ ID NO: 412 - protein, 1010 aa, Chlamydomonas eugametos (chloroplast)
  Ceu ClpP precursor
MPIGVPRIIYCWGEELPAQWTDIYNFIFRRRMVFLMQYLDDELCNQICGLLINIHMEDRSKELEKKEIERSGLFKGGPKTQKGGTGAGETGASSIQNKKSNSSSFEDLLAADEDLGIDENNTLEQYTLQKITMEWLNWNAQFFDYSDEPYLFYLAEMLSKDFNKGDARMLFSNNNKFSMPFSQMLNTGSMSDPRRPQSTNGANWNSSEQNNSLDIYSPFRMLANFEAQDYDFKQINPSLASKEEVFKLFNNTILKNGGQRNNNMSKLLTELAQRNWENKTNSQENLYKSTEKALSQRNLRKEYIKDRTLNNYSSDPFNTKGYVNAQGASTGPSPRTRGMHADGSLNYLDFYSYNDSYNDFKTAPRGKQAERAFQEEESKKVFVIINSFGGSVGNGITVHDALQFIKAGSLTLALGVAASAASLALAGGTIGERYVTEGCHVMIHQPECLTSDHTVLTTRGWIPIADVTLDDKVAVLDNNTGEMSYQNPQKVHKYDYEGPMYEVKTAGVDLFVTPNHRMYVNTTNNTTNQNYNLVEASSIFGKKVRYKNDAIWNKTDYQFILPETATLTGHTNKISSTPAIQPEMNAWLTFFGLWIANGHTTKIAEKTAENNQQKQRYKVILTQVKEDVCDIIEQTLNKLGFNFIRSGKDYTIENKQLWSYLNPFDNGALNKYLPDWVWELSSQQCKILLNSLCLGNCLFTKNDDTLHYFSTSERFANDVSRLALHAGTTSTIQLEAAPSNLYDTIIGLPVEVNTTLWRVIINQSSFYSYSTDKSSALNLSNNVACYVNAQSALTLEQNSQKINKNTLVLTKNNVKSQTMHSQRAERVDTALLTQKELDNSLNHEILINKNPGTSQLECVVNPEVNNTSTNDRFVYYKGPVYCLTGPNNVFYVQRNGKAVWTGNSSIQGQASDIWIDSQEIMKIRLDVAEIYSLATYRPRHKILRDLDRDFYLTATETIHYGLADEIASNEVMQEIIEMTSKVWDYHDTKQQRLLESRDSTTSGADTQSQN

SEQ ID NO: 413 - protein, 992 aa, Candida glabrata
  Cgl VMA precursor
RKELKRLSLDDEAGESQYGAIYSVSGPVIVAENMIGCAMYELVKVGHDNLVGEVIRIDGDKATIQVYEETAGVTVGDPVLRTGKPLSVELGPGLMETIYDGIQRPLKAIKESSQSIYIPRGIDTPALSRDIKWQFTPGTFKTGDHISGGDIFGTVFENSLVESHKILLPPRARGTITWIAPAGEYTVDEKILEVEFDGDKYDYTMFHTWPVRVPRPVAEKLSADYPLLTGQRVLDSLFPCVQGGTTCIPGAFGCGKTVISQSLSKYSNSDTIIYVGCFAKGTQVLMADGSNQSIENIKIGDKVMGQDGKPRNVTALPRGYDDMYNVELDGETDLSYTCNSNHTLVLKTEQNVLLAGNTVSYFALGALIDETNGRAVEIVQEVQETFESNISASDFAANINREPISWTLEIRDIDYLSERVRMFTKQSVNPVLLETPTLAKQLESNESTATNLAYLLGTWIASKATTAGTISVPTTKADLLSKVKSALSSLSIDYSSESINSVSTYRRTQSIPLMENGKHVGNANITAEQEIEETMEVLSLNVTNHSSKLFHDLALSMINQDGSRSIPSAFTHEQLCVRESFVAGILDMQGCNIENGVEIDSSINGLAKLSRSLGLRCNKSSNLLKLSGNMSNISAQSTNNWTSTEDNSSAYKAQLMDFSVQKLPKDNYYGVTLDDDSDHQFLLSNLVLVHNCGERGNEMAEVLMEFPELYTEMSGRKEPIMKRTTLVANTSNMPVAAREASIYTGITLAEYFRDQGKNVSMIADSSSRWAEALREISGRLGEMPADQGFPAYLGAKLASFYERAGKSVTLGSPNRVGSVSIVAAVSPAGGDFSDPVTTATLGITQVFWGLDKKLGQRKHFPSINTSVSYSKYTNVLNKFYDSNYPEFPTLRDRMKEILSNAEELEQVVQLVGKSALSDSDKITLDVAALIKEEFLQQNGYSTYDAFCPIWKNFDMMRSFIAYHDKAQKAVSNGANWNKLSEAVSDVKHSVSS

SEQ ID NO: 414 - protein, 959 aa, Chilo iridescent virus
  CIV RIR1 precursor
MSDIIIDLSRDSKFDELGLKRLRESYMMREETSPQERFAYVCKQVGTDRDHSQRLYEYTSKHWLSLSTPILSFGKANHGLPISCYLSWIEDTKEGLIDTLSEVNQLSMLGGGVGVGVGIRTSDNKSTGVMSHLNTYDACSLAYKQDGVRRGSYAMYLNNNHPDVLQFIEMRKPTGDHNIRCLNLHHGLNISDEFMELIEKCDGGGNIDDTWNLIDPHTKKITTVGARDLWQRILETRMKTGEPYICFIDTCNKHMYDFQKKKGLTIKQSNLCVAPETMILTEDGQFPIKDLEGKIIKVWNGNEFSSVTVVKTGTEKELLEVELSNGCTLSCTPEHKFIIVKSYTEAKKQKTDDNAIANAERVDAQDLKPRMKLIKFDLPTLFGNSEHDIKYPYTHGFFCGDGTYTKYGKPQLSLYGDKKELLTYLDVRTMTGLEDASGRLNTWLPLDLAPKFDVPINSSLECRMEWLAGYLDADGCVFRNGTNESIQVSCIHLDFLKRIQLLLIGMGVTSKITKLHDEKITTMPDGKGGQKPYSCKPIWRLFISSSGLYHLSEQGFETRRLKWEPRQPQRNAERFVEVLKVNKTGRVDDTYCFTEPINHAGVFNGILTGQCSEIILPTDSTRTAVCCLSSLNLEYYDEWKDNDLFIKDVMEMLDNALTIFIEKAPPTISRAVNSAKKERSIGIGVLGFHSFLQQKNISFESDEAAKLNIDIFTKLRSKIDTFNLVLGSLRGSPEDAEGTGRRFCCTMAVAPTATSSIIMGNTSPSVEPFRANAYRQDTLSGSFLNKNRYLSRILSQRLNVKEINEVWSNIVSNGGSVQQLPNNLLSEQEKQVFKTAFEINQKWVIKHAADRQKYIDQSQSINLFLKPDIHKRELHSLHLNAWKSGLKTLYYLRSEKIADADKISSNHMINSINFTNIKESIKDSIKVSILEVRNKEKNYEEKICKLTNGRRLSGCFACE

SEQ ID NO: 415 - protein, 596 aa, Cryptococcus laurentii strain CBS139
  Cla PRP8 precursor
MKSNPFWWTNQRHDGKLWALNNYRVDVIAALGGVEGILEHSLFKGTAFPTWEGLFWEKSCHAEGTELIKFDRSVVKVEDVVEGDRLLGPDGSPRLVSNLVSGCDRLYRFEFSRSGGEVESLVVTDNHIMMLKRANVVLSGSGDAGQLEVLDQISVREQFEIVQKTAAEVAAMSEAEREQYRVYRSEGFEHYEQPVDVHPYFLGLWLGDDSRSANAATNGEPEVRKFLTDYAGELDMHLAHHGDEKRDRRTVKAARLAAGWTLLPRTEGKAGAWIPPATAGYVAPTHSPAPNLRDADGHRSVSAPSQVDEKPEVSHDDEDMEISDTEEEQSDAIEEIEADDDDAAIVMEGPHGQLTPGGRRDEMQPAKARRRVRRLNRNQRYGDLADAEVEALLEDVVSGGQSDGQVVRSAQLLDKLQSLGVATSNEKEKPAQGSKHIPQVYLENTRDVRLRVLAGLLDSHGCLVSPENCYMFSQPETDGRLFWDAVHLARSLGFGVSTDRKTQMNPGSDVATPHLLALITGDLTQVPCLLRRQQAVQRYLPQQHTFRIKSVTLESKSTPWYGFAVDSDRQYLRHDWMVLHNSGFEESMKFKKLTNA

SEQ ID NO: 416 - protein, 215 aa, Filobasidiella neoformans (Cryptococcus neoformans) Serotype A, PHLS_8104
  Cne-A PRP8 (Fne-A PRP8) precursor
DVISALGGVEGILEHSLFKGTAFPTWEGLFWEKACLQNGTRLLRADGSEVLVEDVQEGDQLLGPDGTSRTASKIVRGEERLYRIKTHEGLEDLVCTHNHILSMYKERFGREGAHSPSAGTSLTESHERVDVTVDDFVRLPQQEQQKYKLFRSTDFVRREQPSASKLATLLHINSIELEEEPTKWSGFVVDKDSLYLRYDYLVLHNSGFEESMKNK

SEQ ID NO: 417 - protein, 236 aa, Cryptococcus neoformans (Filobasidiella neoformans), Serotype AD, CBS132).
  Cne-AD PRP8 (Fne-AD PRP8) precursor
HDGKLWQLNNYRVDVISALGGVEGILEHSLFKGTAFPTWEGLFWEKACLQNGTRLLRADGSEVLVEDVQEGDQLLGPDGTSRTASKIVRGEERLYRIKTHEGLEDLVCTHNHILSMYKERSGSERAHSPSADLSLTDSHERVDVTVDDFVRLPQQEQQKYQLFRSTASVRHERPSTSKLDTTLLRINSIELEDEPTKWSGFVVDKDSLYLRHDYLVLHNSGFEESMKNKRLTNAQR

SEQ ID NO: 418 - protein, 2532 aa, Cryptococcus neoformans var. neoformans JEC21
  Cne-JEC21 PRP8 precursor
MSTVPPGFGAPPPGFTPQPNGNGDGMEGDFFGQLSQEEIDKKARKWRQSQKRRFNSKRRQGGGGGVDFGKADLPPEHIRKIIKDHGDMSNRKFRNDKRVHLGALKYVPHAVMKLLENIPMPWEQVREVPVLYHISGAITFVNEVPRVIEPVYHAQWASMWLAMRREKRDRRHFKRMRFPPFDDEEPPMDYGDNVLDVEPLEAIQLELDEEDDEAILEWFYDPKPLVDTPQVNGSSYKYFQLALPQMANLYRIGRQLLSDYSDNNAFYLFDKKSFFTAKALNIALPGGPKFEPLYRDMDAFDEDWNEFNDINKIIIRNVIRSEYKVAFPHLYNSLPRSVYIGVYHEPKNVYIKTDDPDLPAFYFDPLINPISQRVVQEAHTPLVSHEDQVFGFGNDEDVEFELPEEVEPFLGERDLENENTSDAIALYWAPYPYNLRSGKMKRAQDVPLIKNLYLEHCPDGQPVKIRVSYQKLLKVYVLNALHNKPPKAMVKRNLFRSLKNTKFFQATTLDWVEAGLQVCRQGYNMLNLLIHRKNLNYLHLDYNLNLKPIKTLTTKERKKSRFGNAFHLCREILRLTKLIVDAHVQFRLGNVDAFQLADGLQYMFAHVGQLTGMYRYKYKLMKQIRMCKDLKHVIYSRFNTGPVGKGPGVGFWAPGWRVWLFFMRGIVPLLERWLGNLLARQFEGRNSKGIAKTVTKQRVESHFDLELRAAVMHDILDMMPEGVKQNKAKTILQHLSEAWRCWKANIPWKVPGMPAAIENIILRYVKSKADWWTSVAHYNRERIRRGATVDKAVVRKNLGRLTRLYLKAEQERQNGYLKDGPYITSEEGTAILISTAHWFESRKFAPIPFPPLSYKHDTKLLVLALEKLKEAYSVHGRLNQSQREELALVEQAYDNPHECLSRIKRLLLTQRAFKEAGIEFFDTYDKLIPCYDVEPLEKLSDAYLDQFLWYEADKRRLFPSWVKPSDSEPPPLLVYKWCQGINNLTDIWDTSEGESVVMMETVLARVYEKVDLTLLSRLLRLIMDHNLADYITSKNNTTLTFKDMSHINTYGMIRGLQFSSFVFQYYGLVLDLLILGLERASEIAGLPEAPNGFLQFKNREIETKHPIRFYSRYVDRIHMLFRFTAEESRDLIQRYLSVQPDPNNENVIGYNNKRCWPRDCRMRLIKHDVNLGRAVFWNVKNSLPRSLTTIEWEDTFVSVYSKDNPQLLFSMCGFEVRILPRVRTQHGEAYSLKDGVWNLTQESTKERTAQAFLRVSDQGIQDFNNRIRQILMSSGSATFAKIINKWNTCLIGLMTYYREAVVHTNELLDSLVKAENKVQTRVKIGLNSKMPSRFPPCVFYSPKELGGLGMLSMGFVLIPQSDLRWSKQTDSGGITHFRSGMTHEEDQLIPNLYRYLQPWEAEFLDSARVWSEYALKRKEATASNRRLTLEDLEDSWDRGIPRINTLFQKDRHTLAYDKGWRVRQYFSQFFRLRNQPFIWTNQRHDGKLWQLNNYRVDVISALGGVEGILEHSLFKGTAFPTWEGLFWEKACLQNGTRLLRADGSEVLVEDVQEGDQLLGPDGTSRTASKIVRGEERLYRIKTHEGLEDLVCTHNHILSMYKERSGSERAHSPSADLSLTDSHERVDVTVDDFVRLPQQEQQKYQLFRSTASVRHERPSTSKLDTTLLRINSIELEDEPTKWSGFVVDKDSLYLRHDYLVLHNSGFEESMKNKRLTNAQRSGLSQIPNRRFTMWWSPTINRANVYVGFQVQLDLTGVFMHGKIPTLKISLIQIFRAHLWQKIHESVVMDLCQVFDQEMEALQIETVQKETIHPRKSYKMNSSASDILLFSSYKWQISRPSLLTDNRDTMDGTTSNKFWLDIQLRWGDFDSHDIERYARAKYLDYSSDSQSIYPSPTGNLIAIDLAYNLYSAYGCYFPGLKPLLQQAMAKIMKANPALYVLRERIRKGLQLYSSEPTEPYLNSSNYSELFSNQIIWFVDDTNVYRVTVHKTFEGNLTTKPINGAIFIFNPRTGQLFLKIIHTSVWAGQKRLGQLAKWKTAEEVAALVRSLPVEEQPKQVIVTRKGMLDPLEVHLLDFPNIVIKGSELQLPFQATLKMEKFGDLILRATQPQMVLFNLYDDWLKSISSYTAFSRLILILRALHVNNEKSKIILRPDKNTITESYHIWPSLSDDEWMKVEVALKDLILADFGKRNSVNVASLTASEIRDIILGMEIAAPSVQRQQMAEIEKNTEAAAQVTALQTKTTNIHGDEIVVTTTTQYEQQTFASKSDWRVRAISATNLPLRVNHIFVGNDDVKDDAGSYTYVIPKNVLRSFIVNADLRTQVVAYLYGTSPPDNKQVKEIKAVAWIPQRGTNNGVDLPVTLPKHDFLLKDLEPLGWIKTQSQELNHLSPQDVTTQAKIMAAHPEWGPQSICVTCSFTPGSVSLNAWDLTVAGFEWGRKNEDVTGQNPGFNPSMANRVQLLLSDRILGMTLVPEGGIWNYGVGLTQSWSEKIPYTMTLDKPEAFWAPCHRPNAFLNFASMEGDDAADVENSLE

SEQ ID NO: 419 - protein, 849 aa, Clostridium thermocellum
  Cth TerA precursor
MYDEAKAQHAVNFINCLKHTKGQWRGVPFDLLPWQDKIIRDIFGTVKENGYRQYNTAYVEIPKKNGKQLALDTPIPTPDGWTTMGEIKAGDKVIDEKGRPCNVVAISEIDDTEQAYKINFRDGTSIVAGERHLWKVQVTNNGRREKLLTTGEMYQKQFKTKSKENRALFRIPIADAFILPENKLPIDPYLFGYWIGNGNAVKPEITVMRDDVDEVIKNIPYKLHNRYKQEGNSDILVYKELKSILVKNFREKRIPIEYLRASAQQRKRLLQGLIDSDGCVSTAKSQAIYVTILFELAKDVQDLLWSLGIKNTLKTAPSARYGIETGEICYLIKFTAFNDLEVSGLDRKLKRGRERNIKTRSHFHYIKSIEKTGKTKMRCIQVDSPSRLYLAGKSMIPTHNSELAAAVALYMTCGDGEWGAEVYGCAADRQQASIVFDVAVEMVEQCPALKKRIKPVLSVKRLIYKPTNSFYQVLSAEAYSKHGLNVHGVVMDELHAQPNRDLYDVMTKGSGDARLQPLFFLITTAGTDRNSICYEVHQKAVDILEGRKIDPTFYPVIYGIDDNDDWTLEKNWYKANPSLGHTIDIEKVRNAFNSAKENPAEENIFRQLRLNQWVKQSTRWMQMDKWDECAFKVDIDSLKGRECYGGLDLSSTTDITAFVLVFPPRTSDEKYIVLPHFWIPEDNLNLRVRRDHVPYDIWKKQGYLKTTEGNVVHYGYIETFIEELGKKYNIKEIAFDRWGAVQMVQNLEGMGFTVVPFGQGYKDMSPPTKELMKITLEKKIAHGGHPVLRWMMDNIYVKTDPAGNIKPDKEKSTEKIDGAVALIMALDRSIRHENKESVYEKRGMRSFLD

SEQ ID NO: 420 - protein, 1088 aa, Candida tropicalis (nucleus)
  Ctr VMA precursor
MAGALENARKEIKRLSLDDTNESQYGQIYSVSGPVVIAENMIGCAMYELVKVGHDNLVGEVIRINGDKATIQVYEETAGVTVGDPVLRTGKPLSVELGPGLMETIYDGIQRPLKAIKDESQSIYIPRGIDVPALSRTVQYDFTPGQLKVGDHITGGDIFGSIYENSLLDDHKILLPPRARGTITSIAEAGSYNVEEPVLEVEFDGKKHKYSMMHTWPVRVPRPVAEKLTADHPLLTGQRVLDSLFPCVQGGTTCIPGAFGCGKTVISQSLSKFSNSDVIIYVGCFTKGTQVMMADGADKSIESIEVGDKVMGKDGMPREVVGLPRGYDDMYKVRQLSSTRRNAKSEGLMDFTVSADHKLILKTKQDVKIATRKIGGNTYTGVTFYVLEKTKTGIELVKAKTKVFGHHIHGQNGAEEKAATFAAGIDSKEYIDWIIEARDYVQVDEIVKTSTTQMINPVHFESGKLGNWLHEHKQNKSLAPQLGYLLGTWAGIGNVKSSAFTMNSKDDVKLATRIMNYSSKLGMTCSSTESGELNVAENEEEFFNNLGAEKDEAGDFTFDEFTDAMDELTINVHGAAASKKNNLLWNALKSLGFRAKSTDIVKSIPQHIAVDDIVVRESLIAGLVDAAGNVETKSNGSIEAVVRTSFRHVARGLVKIAHSLGIESSINIKDTHIDAAGVRQEFACIVNLTGAPLAGVLSKCALARNQTPVVKFTRDPVLFNFDLIKSAKENYYGITLAEETDHQFLLSNMALVHNCGERGNEMAEVLMEFPELFTEISGRKEPIMKRTTLVANTSNMPVAAREASIYTGITLAEYFRDQGKNVSMIADSSSRWAEALREISGRLGEMPADQGFPAYLGAKLASFYERAGKATALGSPDRVGSVSIVAAVSPAGGDFSDPVTTSTLGITQVFWGLDKKLAQRKHFPSINTSVSYSKYTNVLNKYYDSNYPEFPQLRDKIREILSNAEELEQVVQLVGKSALSDSDKITLDVATLIKEDFLQQNGYSSYDAFCPIWKTFDMMRAFISYYDEAQKAIANGAQWSKLAESTSDVKHAVSSAKFFEPSRGQKEGEKEFGDLLTTISERFAEASE

SEQ ID NO: 421 - protein, 1103 aa, Chlorella virus NY2A infects Chlorella NC64A, which infects Paramecium bursaria
  CV-NY2A RIR1 precursor
MVGRPMNRLMVVLKRDGSKENISFDKILQRIQRLCWPINSKPVYKGSRAMTGLSVDVSKIVASVCASIVDGISTVQLDELTADKSASMTTEHPDYGILAARISVSNLQKQTHDKITDAYAEIAHLLSNDFKENIEKHADEYQSFIDYDRDYDFDYFGFKTMERLYLTKVNNKIVERPQHVYLRVAIGLWGSDIARVKETYDALSCRKFTHASPTLFNAGFKKAQLASCFLVTVEDSLGDIYKVLGDCAQLSKHGGGLGINISEIRGRGSRINGTNGESDGIVPMLKVFDTTSAYANQGGRRKGSFAIYLEPHHSDVMDFLLMKRNQGEESLRARNLFYAVWLNDLFMKRVETDAQWSLFDPSECPGLTDAFGDEYAELYERYEAEGKAKNVVKARDVWNTMVTTIIETGQPYVSNKDAVNKKNMQMNAGTIRGSNLCVAGDTKILTSSGYHPIKDMEGKQVRVWNGYEFSETIVHKTGVNQKLIMVSLDDGTELRCTPYHKFYIETGSRPADKSRVMEVRAGDLEKGDRIIRFELPTITVGETTMSDKEAYTKGFFSADGCVIKSKYGEDEYRISVKREDKIEALTKYVDVIKSHTNRFRTHFYVPDYVQNKFEVPINSMVNEKISWLAGFMDGDGCVIRYKDIENMQAVSINKSFLQDIRLMLQTIGIHSTINKFMPNRVMKMPDGRGGTDMYNGAESWRLQIDSEGVRKLFALGFTPRRLKMNGSRKRHHKTNKFTRVVSVTDHGDVEDTYCFNEPKRHMGVFNGVITGQCNEIVEYTSKEETAVCVIGSVVLKNYVKNDKFDFDDLRKNVKILAKNLDRSIDVMAYPIKEAETSNKLRRPIGVGVQGLQDVFFKLRFSYDSPEARDLNREIFEHIYYAAVEASVELAEIHGPYPTFEGSPASKGILQYHLWDVTPKSNLDWRGLEERVKKGIRNSLVTALMPTASTAQICGSVEAFEPITSNLYSRRTLAGEFPVINSYLVRELIERGTWNEQMKNQIIANGGSIQKVIGIHPSVKAVYKTAWDLSMKSVIDMASDRGAFVDQTQSMNLFLAQPTLKNVTSMLFYGWKSGLKTLQYYLRSKPASSAIAVTIDNDCLVCSA

SEQ ID NO: 422 - protein, 1222 aa, Crocosphaera watsonii WH 8501 (Synechocystis sp. WH 8501)
  Cwa PEP precursor
MITTTYEITPTVKRETAFILWFEEVGSKDVDLVGGKNSSLGEMIQQLQPKGVNVPTGFATTAHAYRYYIESAGLESRLRDLFTDLDVNDVTNLQERGQLSRSLILNTPFPKELEAAIIEAYKMLCDRYSHECSKLQEKYREECKIETQNLDVAVRSSATAEDLPEASFAGQQETYLNIHSVKGVLEACHKCFASLFTDRAISYRHHNGFDHFAVALSVGVQKMVRSDLASAGVMFSIDTETGFKNAALITAAYGLGENVVQGAVNPDEYYVFKPTLQDGYRPILEKRVGTKAIKMIYDTGGSKLTKNVDVLPEEQEQFCLNDEEILKLANWACIIEDHYSRVRETYTPMDIEWAKDGRTGELYIVQARPETVQSQKAANVLKTYKLQDHSTVVAVGRSVGASIGQGEARVILEASKIDQFKPGEVLVTNRTDPDWEPIMKKASAIVTNQGGRTCFDGKTKILTNQGFMTLRQVYEQGYEGLSTLSLNTKTHKIEWKPILDTMKRQSEMIDISVSQTGRITDNTLRLTPDHKMVNLRGGKYTKTEIQDLLKQQEMLTVAQTIPSLGNNKHQEADLAYFLGGIITDGSIYTSSTRGEVQFIQKDVPEKQAFISKMNDLANSLYGKSFTAHIKPVSSSYIRGQKVTGQATAYRLHSKAIAYDVKERENNITQLLLENEAELSYHFLGGVIDGDGCYHKNRLHIYISEENLLQAVIIACLKMNTVPQVTKNRNIYHLQIVEKLEVILRYTQRVKGEVTPRTIQTRFFATRQLFENQETGQIKLRQDNNCLISDKQLREMGEFEELIDGDTRMQRVIQVGEKSDGDVYNITVAEHHNYVVFTAKYTPVVVCNCHAAIIAREMGIPAIVGCGDATDKIKTRQEITVCCSEGEKGRVYDGLLPFEVEETPLDNLPVTRTQILMNVGNPEKAFSLANIPAQGVGLARLEFIIANHIKAHPLALMKFDELEDEAVKEQIAELTKRYDNKPQFFVDKLAHGVATIAASFYPKPVIVRMSDFKSNEYANLLGGQGFEPKEDNPMIGWRGASRYYDPMYREAFALECQAMKTVRDDMGLVNVIPMIPFCRTPEEGKKVIAEMAKNGLKQGVNGLQIYVMCELPSNVILADQFADVFDGFSIGSNDLTQLTLGLDRDSALVAQLFDERNEGVKRMVKLAIETAKKKGRKIGICGQAPSDYPEFAKFLVELGIDSMSLNPDSVLKTLLMVAEVEKG

SEQ ID NO: 423 - protein, 1115 aa, Crocosphaera watsonii WH 8501 (Synechocystis sp. WH 8501)
  Cwa RIR1 precursor
MQPTVLTSPKQTSHGDTQTSSLYHSQLGESKIRVRRRDGSWTALNIVKIRAVVDWACADREVNSIALEAGLTTRLRDGITTREIQDNLINCALEMCSPDEPDWRYIAGRLHIWSLWKDTLVSRGYQYGNYEIVAKTKIDAKQYDNRLLTYSTAELQEAGSWINPDWDTDYDYAGAVLLTSRYLLDDELPQEAFLTCALLLATVESPENRLPWAKRFYEAIAKGKVSLATPILANLRVPGGSLTSCFILSIDDNLESIFEEITNTARISKNGGGVGVNVSRIRATGSWVMGKNNASGGVIPWIKLLNDTAIAVNQGGRRAGAVTVGLDIWHLDVPEFLEIQTENGDQRRKAYDVFPQLILTDEFMRRVENKEEWTLVDPYQVKEKLGIELAELWGEKFEEAYGLIEAELDREITLYKRVNARELFKTIMRSQVETGMPYLAFKDTINKANPNKHVGYIPGVNLCVAPETKILTDRGQIAIADVAGEKVNIWNGSEWSEVLVKKTGENQPLLKVHFSNGESLDCTYYHKFHVQENYKGKVKIVEAKDLQEGDKLIKYRLPLVESENDIDFPYAYTSGFFSGDGSHDGMGKPEIDLYGEKKELLPFVTVRNKYYGGSYGDKSWRIERDEVAVYDDVNQDRIVCKLPLDIPAKFTVPVNGYTIQSRLEWLAGLLDADGTVARNGDNESLQVASTHQQFLLDIRLMLQTLGVDSKVVKMDEMGYRSLPDGKGGYQDYFCQAKYRLLISSNGLFQLGELGLKTNRLQWNLREPQREASQFIRVEKVELTCRYDDTYCFSEPKRHLGMFNGILTGQCTESFSNVTPGKFAHCCNLVSLNLANIEEEELDYLCNISVRILDNTIDITNPPFNDAKAHNDRYRTVGVGCMGLADWLAKKGLTYENITEISNLFEEVGYWCTHTSMELAKERSPYNAFEGSDWSKGLLIGSKPVDWFVENASKKERWVQLSEDIKTYGIRNSHITAIAPNTSSSLVQGCTASILPVYSRFFYDKWAKGTIPIAPPFIKESFWFYHENKTLEQQKVVKAVATIQQWIDTGISMELLFNLNQGVYFADEPERCLTAKDIFETLLLAWKEGCKAIYYVRTVQKDDFKESDNNCTACAN

SEQ ID NO: 424 - protein, 378 aa, Costelytra zealandica iridescent virus
  CZIV RIR1 precursor
PEIISFLNTRRVSGFGGDYNYKLMNIHNGVNIPDNFMRKIWFISTVAPILKQENGKRMKMLEEAIKTFQNSDKWVDENNLDLNKLTIENAQTYIKEMDKFDLTDPHNKEVKETISATELWERILVTRAECGEPYCHFIDTSNRKLPEFQKKLGLNIKQSNLCVVGETLVLTQNGQFPIKYLVNQYVKVWNGEEWSEVVVKKTGFNQELVRVDFNNGTSIICTPYHNFLSLEDDSTIKNLKRICAQDLPCNFKVLYFYQNLDFVTTVKVTKITHLSQRADTYCFSEPLNNAGVFNGILTGQCSEIILPTDENRTAVCCLASLNLDYYDNWCDNEQFYLDVATYLDNVLQYFIDNAPRSLKRAIYSAESERAIGIGVMGL

SEQ ID NO: 425 - protein, 1608 aa, Dictyostelium discoideum strain AX4 (nucleus)
  Ddi RPC2 precursor
MDPESVGYCNNPDFLHKGSMDELYNISKLTDDIKPVEEKWKLVPAFMKCRGLVKQHIDSFNFFINVEMKKIVKANERLTAENDPSYFVRFTDINVGSPTSTEDNLDSVQLTPQRCRLRDMTYSAPIFVNIEYTRNKQIISKRDVHIGNIPIMLRSSNCVLSKKTPEQMAALGECPMDPGGYFIVRGQEKVILNHEQLSKNRIIIEMDSKGLPSASVTSSTHERKSRTGVTLKNEKLYLKHNTFGEDIPVAIVLKGMGVETDQEMAQLVGSDDVFLNAITPSLEECQKCGVHTAAQALDYLGSRIKVFRRPYGVQNKKTKSEEARDILAGVVLNHVPVRRYNFRLKVIYLSLMIRRIIMASKDKSCLDDKDYYGNKRIELSGQLISLLFEDCFKKFQSELKKSVDQAIAKANRAENLDLPKLIRTDTITNGFTHAISSGQWNLKRFRMERSGVSQVLSRLSYISCMGMMTRIQSQFEKTRKVAGPRSLQPSQWGMLCPSDTPEGEACLHPDTIITMSNGQQKPIRQLKDGDSIITLDPITMEAHSTRIYSHFIKSSSQYGKQLLKITTITGKEIICTNDHRFLTSNGNWKQSKDLLLNDKLFLISSSNQLEFNNNNNENNNENNNDIIEILNENQLINQGVVPIKIIQELKSIELLPLLNNNEKLITISRIIGSIDKIGSNKQNEPIIQYQFNLISDFDQFLKDLQYLGFINPIYKLNEEQQQQQQQKIDHQQQQQQQVEQQQKSIIIDFIGSSFGYFIQSLLNEKNWIEKSNNQFVKKEFLSSFISNVNRIQFNIIEEINQQNNDSNFKILLNYKQQKQQQNEKEERAVVDHDNEIFNIKSLQILLNQFNVISSIDFEESNLIIINSSLKKFIDLINIKFNQKLNNQIIQIREYLNYINYNNNNNNNEEINIKKKDFGYFKKLKIKRNSFEIEIEKIEQLNYQDCPEISDFTTESDYHSMISNGFVSHNCGLVKNFALMSHVTTDDSEGPLLRLAYNLGVQDILLVTGEELNSRNAYLVLLNGQIIGIHNSPDYFVTTLRKMRRAGRIREFVSICKNKAQQTISVACDGGRLCRPVIIVDDQRPRLTQEHIEDLKDGLRTFDDFIREGIIEYLDVNEENDSFLAWREAAIQPWTTHLEIEPFTMLGCVAGLIPYPHHNQSPRNTYQCAMGKQAIGAIAYNQLTRIDTLLYLLVHTQRPLCQTRTIDLLNWYKLPAGHNATVAVMSYSGYDIEDALVMNKASLDRGFGRCIVLKKQVTSIKKHGNDTSDRIFPPTPNDLRQPKYGLLDSDGIAKPGELAQKGQILVNKYSPLNTIDATPNPELIPDSAYKSSYMGYKYDNPAFIDKVLLTSGDDEQLLIKMLMRSTRRPELGDKFSSRHGQKGVCGIIVKQEDMPFSDLGICPDIIMNPHGFPSRMTIGKMIELLAGKAGVLSGKFGFGTCFGGDRVENISKVLISKGFSYGGKDYVTSGVTGEPLACFIFFGPIFYQKLKHMVMDKMHARARGPTVTLTRQPTEGRARGGGLRLGEMERDCLIGYGASALIMERLMISSDRFTVYACKNCGFLGYEGYCQYCKSSVDISTIQIPYACKLLFQELQAMNIVPRLKLVDS

SEQ ID NO: 426 - protein, 849 aa, Deinococcus geothermalis DSM11300
  Dge DnaB precursor
MELTPRVPPHSNEAEISVLGSILLDNDTLIGLGDTLTPEMFYREGHRKIFAAMRALQERGEPVDLVTLSEHLRVQGQLDEVGGLTYLIGLSEQVPTAAYAEHYARIVQEKHTLRQLISASGKAMQLAYEGQLPLEDLLDRAEKMIFEVAEQKKKSEAFQAMGEVVHETFEYITLLHQNRGIPDGVSSGFRDLDEQISGFQKGSLNVLAARPSMGKCVTADTLIDVPGTGERITVEAFVRRQWPVVLSVSADGRVRESRVGAWIDSGVKPVRRVTTRTGRVVETTPHHPFLGVDGWTPLYDLKVGDRIAVPRAVPVFGQRDVLSAERVRLLAYLLAEGGLTQSGPRWTNADPELVQDFRACLAAEFPEVEMMADAWTGIDDRLSRRWQPGERQDRPNPLIGWLRELGVWGQPTDAKRFPAVVWTFTRPSLAAFLRVLLSCDGTLSTLAGKARIEFTVASEGLARDVHHALVRFGIVSKLWRKGERSWRVEITDPRSVADYQLQIGWLGEKALRTIPVSAETRSHVGHPPAGAWAHVRRAAGERTASGFNAHTGRSLPQSRAARYAAVLDDTQLTLLGSDALYWDDIVSIEDVGERQVYDLTVPGDANFIAADICLHNTAFALSIAQNVALRGEKTVAVFSLEMPAVQLALRMLCSEARVDMNRIRSGQLNERDFERLAHAAGRLADAPMIIDDEPDLTLNALRSKLRRIAAQHGQLGLVVIDYLQLMSGGKNSGGSDNRQQEISTISRGLKGLAREMEVPIIVLSQLSRAVEQRPNHRPMLSDLRESGAIEQDADIVMFIYRDEYYNKETDQQGIAEIIIGKQRNGPVGTVKLQFHSAHVRFNDLAPEGV

SEQ ID NO: 427 - protein, 1111 aa, Desulfitobacterium hafniense DCB-2
  Dha-DCB2 RIR1 precursor
MLYRVASIIAQVEETFGKTKKEVKELAKSFYEMMAKLEFMPNSPTLMNAGRDLGQLSACFVLPVEDSMEEIFDAIKSAAIIHKSGGGTGFSFSRLRPKNSTVRSTGGVASGPVSFMKVFNAATEAVKQGGTRRGANMGILRVDHPDIREFITCKEDNKEITNFNISVGITEEFMKAVQEKRHYNLIDPHTKEADGQLYAPEVFQLIVDHAWRNGEPGIIFLDRLNRDNPTPQLGEIEATNPCVTGDTWVLTEEGAAQVRDLLGSQVKLALNGEYHETSKEGFFATGVKQVLTLKTQQGYELKVTADHLVRVASDMTRYKVTQEWKPAGELKPGDTIVLSNNRSIQWQGKGTKEEGYLLGLLLGDGTLKEEGAVISVWGEGEEAKSMMEAAEKAAFSLTHRQDFQGFQKEISERHEHRMRFAALRDLAQQYGILPGSKAITQELEKTGQDFYQGLLRGLYDTDGTVTGTQEKGVSVRLWQTDLAGLKVVQRMLQRLGIISTLYEERKPAGQKLMPDGQGGSKEYPVQAGHELVISQDNIEIFAEKVGFSNSKKAQLLAEKLNVYQRSLNRERFVDNIVACVPGDAEEVFDAQVPGINAFDANGIYVHNCGEQPLLPNEACNLGSINLKLMVTEKNGKVVVDWERLGQITRLATRFLDNVIEANTYPLPSIEEMVKGNRKIGLGVMGFADMLILLQTSYASEDAVEYAEKVMNFIQTEARLESQRLAEERGTFPNYQGSIYDGVRPLRNATLTTIAPTGTISMICGASSGVEPLFAVAYTKTVMDGTPLIEVNPIFQSLAEDYGFNSPELMRKIAEKGTVLGFPEVPNWVQEVFVTAQEIEPEWHIRIQAAFQKYTDNAVSKTINFANEATHEDIAKAYELAHELNCKGLTVYRDGSREEQVLSTGITKKAEEKAEEAKTQVSIPKVPFIPEVNTVLPRPRPTTTTGVTEKIRIGCGNLYVSVMADEKGICEIFTNTGRAGGCSSQSEATARLISIALRSGISVDAIIEQVKGIRCPACIRREGVNVTSCPDAIARVIKEYVELGKGKVNSVKVTSQPAVEEKPVQSKSASITNPQKTRATVAEGNACPECGMSINHESGCVVCTHCGYSKCG

SEQ ID NO: 428 - protein, 1153 aa, Desulfitobacterium hafniense Y51
  Dha-Y51 RIR1 precursor
MSFQESAPKAWLKANLTPNARVILEKRYLKQENGEVAESPEDMLYRVASIIAQVEETFGKTKKEVKELAKSFYEMMAKLEFMPNSPTLMNAGRDLGQLSACFVLPVEDSMEEIFDAIKSAAIIHKSGGGTGFSFSRLRPKNSTVRSTGGVASGPVSFMKVFNAATEAVKQGGTRRGANMGILRVDHPDIREFITCKEDNKEITNFNISVGITEEFMKAVQEKRHYNLIDPHTKEADGQLYAPEVFQLIVDHAWRNGEPGIIFLDRLNRDNPTPQLGEIEATNPCVTGDTWVLTEEGAAQVRDLLGSQVKLALNGEYHETSKEGFFATGVKQVLTLKTQQGYELKVTADHLVRVASDMTRYKVTQEWKPAGELKPGDTIVLSNNRSIQWQGKGTKEEGYLLGLLLGDGTLKEEGAVISVWGEGEEAKSMMEAAEKAAFSLTHRQDFQGFQKEISERHEHRMRFAALRDLAQQYGILPGSKAITQELEKTGQDFYQGLLRGLYDTDGTVTGTQEKGVSVRLWQTDLAGLKVVQRMLQRLGIISTLYEERKPAGQKLMPDGQGGSKEYPVQAGHELVISQDNIEIFAEKVGFSNSKKAQLLAEKLNVYQRSLNRERFVDNIVACVPGDAEEVFDAQVPGINAFDANGIYVHNCGEQPLLPNEACNLGSINLKLMVTEKNGKVVVDWERLGQITRLATRFLDNVIEANTYPLPSIEEMVKGNRKIGLGVMGFADMLILLQTSYASEDAVEYAEKVMNFIQTEARLESQRLAEERGTFPNYQGSIYDGVRPLRNATLTTIAPTGTISMICGASSGVEPLFAVAYTKTVMDGTPLIEVNPIFQSLAEDYGFNSPELMRKIAEKGTVLGFPEVPNWVQEVFVTAQEIEPEWHIRIQAAFQKYTDNAVSKTINFANEATHEDIAKAYELAHELNCKGLTVYRDGSREEQVLSTGITKKAEEKAEEAKTQVSIPKVPFIPEVNTVLPRPRPTTTTGVTEKIRIGCGNLYVSVMADEKGICEIFTNTGRAGGCSSQSEATARLISIALRSGISVDAIIEQVKGIRCPACIRREGVNVTSCPDAIARVIKEYVELGKGKVNSVKVTSQPAVEEKPVQSKSASITNPQKTRATVAEGNACPECGMSINHESGCVVCTHCGYSKCG

SEQ ID NO: 429 - protein, 2738 aa, Debaryomyces hansenii CBS767
  Dhan GLT1 precursor
MASYLPQEEFETNVYKYDETPENKSWASTLPTAKGLYNPEYEKDACGVGFTCHIKGEASHKIVSDCRNLLCNMTHRGGELNPKDGDGAGLLSSLPHKFFLREFKYYCNIDLPKLGQYGTGNIFFKKDDIVFEKSRKTFESIANTLGLKVLGWRKVPHDSSILGPASLSREPLILQPAIVLSELFDGQHKEISEEEFEKNYQMDFEKKLFILRKQSTHTIGLHNWFYICSLSSKTIVYKGQLAPNQVYAYYHDLANAEYEAHFALVHSRFSTNTFPSWDRAQPLRWAAHNGEINTLRGNKNWMRAKEGVMESELFGDELDKLYPIIEEGGSDSAAFDNVLELLVINGVLSLPEAVMMLIPEAWQNDIHIDSKKKAFYEWAACLMEPWDGPALFTFADGRYCGANLDRNGLRPCRYYVTDDDRMICASEVGVIEIEPEKILQKGRLQPGRMLLVDTKEGRIVDDRELKNKVASRFDFKSWVLANMISMDDLFSKLESRNVNLIENPESQDITVQTDPRLVAFGYSHEQISMVLAPMAEAKEALGSMGNDNALACISEQPKLLYDYFRQLFAQVTNPPIDPIREEIVMSLECYVGPQGNLLEMKPDQCNRLLLKSPVLSSLELNAIKNIEKVYPKWSVTNIDITFDKAEGIQGYINKIDNICQASSKAIADDHQIIILSDKLTSFNRIPISALIATGAVHHHLVRQKQRSKVAIIIETAEAREVHHACCLVGYGADGINPYLALETLVRMNIENLLKASLTDDQIIKNYKIAVDSGILKVMSKMGISTLASYKGAQIFEALGVDNSVIDRCFAGTASRIKGITFEYIAQDAFSLHDVGYPSRETIKPVALPETGEYHWRDGGDSHINEPAAIASMQDAVKNKNEIAYEAYSKKEYEAIKKCTLRGLLDFDYENSQSIPIDQVEPWTEIVRRFFTGAMSYGSISMEAHSTLAVAMNRLGGKSNTGEGGEDSARSLVHSNGDTMRSSIKQIASGRFGVTSHHLSDADELQIKMAQGAKPGEGGELPGHKVSEQIGKTRHSTPGVGLISPPPHHDIYSIEDLKQLLYDLKCSNPRARTSVKLVSEVGVGIVAAGVAKAGSENILISGGDGGTGAAKLTSIKYAGLPWELGLAESHQTLVLNDIRGRVILQTDGQLRTGRDIAVAALLGAEEWGFATTPLIALGCIMMRRCLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVANCHLNTCPVGIATQDPELRKKFTGTPEHVINFFYYLANELRGIMANLGFRTVNEMIGRTEKLKVREDLRNTKNANMDLSPILTPAHTIRPGVATHCVKKQDHRLHVRIDNKLIDESEITLAKGLPVTIDCDVVNTDRSLGTTLSYRVSKTFGEQGLPHDTIHVNVNGSAGQSFGAFLAPGITLELEGDANDYVGKGLSGGRIIVYPPKESKFNAEDQIIAGNTAFFGATSGAAFIRGIAAERFAVRNSGANIVVEGTGDHGCEYMSGGRVVVLGSTGRNFAAGMCGGIAYVLDMAQDFGDKVNSQNVELSQITEASEIAFVRGLIEDHRHYTSSAVAENILNNFDRILPRFVKVLPYDYEKVLENEKKKQEEAKKNELNTFIKSIKEDPESDATNGEAAKIRKGHIHRPSLATVSAKDCSHEPNVLDLEDTIFDTEVEKKSVAKLDKLKGFMKYKRRNEKYRDAKKRTNDWNEMTSRLTKDELKYETARCMDCGVPFCTSDTGCPISNVIPKWNELVFQDRWYDALQRLLMTNNFPEFTGRICPAPCNGACVLGINSDPVNIKSVECAIIDHGFEQGWIKPEPPQHRTGKSIAVIGSGPAGLATADQLNKAGHSVKVYERSDRPGGLLMYGIPNMKLDKRIVKRRTDLMTAEGVEFICSTTIGEDISIEEIRSSNDAVVFAVGSTIPRDLRIKGRELNNINFAMQLLHKNTKALLDNDLEEIKKTLEGKHVIVIGGGDTGNDCLGTSTRHGAKSVTNFELLPNPPTSRPKDNPWPQWPRVFRVDYGHTEVTEHYGKDPREYSILSKEFVDDGEGNVKGIKTIRVEWKRSDSGAWQMAEVPGSEEFFSADVVLLSMGFVGPDADNLEVTKTKRGTISTVEPNGYKVSNEDNLFTAGDCRRGQSLVVWGIQEGRQCAREVDNYLMGSSRLPGNGSIEQRNFKLLEELAEKV

SEQ ID NO: 430 - protein, 999 aa, Debaryomyces hansenii CBS767
  Dhan VMA precursor
MNRLSLDAGESEYGQIYSVSGPVIIAENMIGCAMYELVKVGHENLVGEVIRIAGDKATIQVYEETAGVTVGDPVLRTGKPLSVELGPGMMETIYDGIQRPLKAIKEKSQSIYIPRGIDAPSLSRTAQYDFTPGQLKVGDHITGGDIFGSVFENSLLDDHKILLPPRARGTITSIAEKGAYTVEDPVLELEFDGKKHSYSMMHTWPVRVPRPVAEKLAANHPLLTGQRVLDSLFPCVQGGTTCIPGAFGCGKTVISQAISKFSNSDLMVYIGCFAKGTEVLMADGSNKNIEEVQIGESVLGKDGEARNVVALPRGNETMYEINESTPEEEADLARIAFTCNAKHELVVNTKQDIAVEQNCVTYFALESVTDEANGREFSVVKSQTKTFEESSMAKEFASTISKNSIDWTIEARDVGHMSDDVRCATQQSWAPVLASKEVLAPVVQEAGFDATIAPYVSYLLGLWIGNGYSDRVQYLIDGKNTELINRVREYDEAIENNNQTSAKTVDFLWDVINSMSFKVEGKSGKAIPSFLRTESFEVREQFLAGLIDSDGIVTKNPLSASVRTNSSKVGEGVIAVSRSLGICTSVKAENESYIISMTRNSALESVLSKCALAEKTTSVPSHITRTGQNFDFSVKKIEAADYYGVTLPDNSDHQFMLANQAVVHNCGERGNEMAEVLMEFPELYTEINGRQEPIMKRTTLVANTSNMPVAAREASIYTGITLAEYFRDQGKHVSMIADSSSRWAEALRELSGRLGEMPADQGFPAYLGAKLASFYERAGKAVALGSPDRIGSVSIVAAVSPAGGDFSDPVTTATLGITQVFWGLDKKLAQRKHFPSVNTSISYSKYTNILDKYYESNYPEFPALRNKLKEILSTAEELEQVVQLVGKSALSDSDKITLDVANLIKEDFLQQNGYSTYDQFCPIWKTFDMMRAFTSYHDEAQKAVANGAQWGKLSEATSDVKHAVSSSKFVEPSEGEEKGKKAFNELLANISEKFAEASE

SEQ ID NO: 431 - protein, 684 aa, Desulfovibrio vulgaris subsp. vulgaris DP4
  Dvul ParB precursor
MLQTETWPIDRLIPYVRNPRKNDEQVDRMVSAIKEFGFRIPVVAKSDGTVVDGHLRLKAAQRLGMTEVPVALADELTEAQVKAFRLLANRSANWAAWDNDLLALEMEELQAMAYDTSLTGFDIAEVDALLAKPAKDGLTDPDEVPETPTEPASAIGDVWILGKHRLMCGDSTNAEHVARLLAGVQPHLMVTDPPYGVAYDPAWRNEALAGQKTRRTGTVLNDDRADWREAWALFPGDVAYIWHGALHAATVAESLAACGFSIRSQIIWSKERLVLSRGHYHWMHEPCQPAGTMVQKVIDPGAGSQSARIAEVPIETLRAGDFVVSYNPYESVIRRRGRQITRFGERQFDGLMHTISAAGRVTRATPEHRFTVRLNPSAADKQLVYLMRRGNWWRVGRVSLFSSRGFGLATRLADNKGEDAWIISVHDNAIEAQCAEQVLSCRYGIPTTHWEVDNWTKVPARQRSPGMIAGIYSCLNLGALSARATLLLRDHRLEREYPFITCGDQLMFSRRTTRLVRACNIHPGIMQIPMPSTGEDFDWITITGNDAAPFSGKVYSMDVDKDLHYVADGLVTHNCWYAVKGQAHWSGDRKQVTVWNIASKGQDAETIHGTQKPVECMKRPMENNSSPGQAVYEPFSGSGTTIMAAELTGRCCYAMELNPAYVDVAVTRWENFTGQKAMRELPHV

SEQ ID NO: 432 - protein, 2959 aa, Emericella nidulans (anamorph: Aspergillus nidulans) FGSC A4
  Eni-FGSCA4 PRP8 precursor
MASLPPPPPPGWGASAPPSMPLAPPPPGYQPPADPNVAKYAQKKTEWLRTQRNRFGEKRKGGFVETQKADMPPEHLRKIVKDIGDVSQKKFTNEKRSYLGALKFMPHAVLKLLENMPMPWESTREVKVLYHVNGCLTLVNETPRVIEPVFHAQWATMWVCMRREKSDRRHFKRMRFPPFDDEEPPLSWSENIEDVEPLEPIQMELDESEDSPVYEWFYDHRPLLDTPHVNGPSYRKWNLDLPQMATLYRLSHQLLSDVVDQNYFHMFDLNSFLTAKALNVAIPGGPRFEPLYKDIDPNDEDFSEFNAIDRIIFRAPIRTEYRVAFPFLYNTLPRSVKVSWYSHPQVVYVRTDNHPNLPAFYFDPVINPISSRSVAPKNITVSHEDEIFGPGGYEDDFELPAEVEPFFADEDLYTPETASAIALWWAPHPFNKRSGKMVRAQDVPLVKHWYLEHCPQGQPVKVRVSYQKLLKTYVLNELHRKKPKAQNKQDLLKTLKSTKFFQQTTIDWVEAGLQVCRQGFNMLNLLIHRKNLTYLHLDYNFNLKPVKTLTTKERKKSRFGNAFHLMREILRLTKLIVDAQVQYRLGNIDAFQLADGILYAFNHVGQLTGMYRYKYKLMHQIRSCKDLKHLIYYRFNSGPVGKGPGCGFWAPAWRVWLFFMRGIIPLLERWLGNLLSRQFEGRHSKGVAKTVTKQRVESHFDLELRASVMADLMDMMPEGIKQNKVNTVLQHLSEAWRCWKSNIPWKVPGLPAPIENIILRYVKSKADWWISVAHYNRERIRRGATVDKTVAKKNLGRLTRLWLKAEQERQHNYLKDGPYVSSEEAVAIYTTMVHWLESRKFSPIPFPSVSYKHDTKILILALERLRESYSVKGRLNQSQREELALIEQAYDSPGTTLARIKRFLLTQRAFKEVGIDMNDNYSNINPVYDVEPIEKITDAYLDQYLWYQAEQRHLFPAWIKPSDSEVPPLLTYKWAQGINNLSNVWETADGETNVMIETELSKVYEKIDLTLLNRLLRLIMDHNLADYITSKNNVQLSYKDMNHTNSYGLIRGLQFSGFVFQFYGLMIDLLLLGLQRASEMAGPPQSPNDFLQFRDRATETRHPIRLYTRYIDKIWVFFRFNADESRDLIQRFLTENPDPNFENVIGYKNKKCWPRDCRMRLMRHDVNLGRAVFWDLKNRLPRSITTIEWDDTFASVYSKDNPNLLFSMSGFEVRILPKCRNLNEEFSVKDSVWSLVDNSTKERTAHAFLQVTEEDIQKFNNRIRQILMSSGSTTFTKIANKWNTALIALFTYYREAAVSTVNLLDTIVKCETKIQTRVKIGLNSKMPSRFPPAVFYTPKELGGLGMISGSHILIPASDKRWSKQTDTGITHFRAGMSHDEETLIPNIFRYIIPWEAEFIDSQRVWMEYSQKRMEAQQQNRRLTLEDLEDSWDRGLPRINTLFQKDRSTLSFDKGFRLRAEFKQYQLMKSNPFWWTSQRHDGKLWNLNAYRTDVIQALGGVETILQHTLFKATAFPSWEGLFWEKACLANGTQLLRYDGTKVNVEDVKEGDLLLGPDGGPRRAFNVVSGKDRLYRIKIDGDKEDLVVTANHILVLHRAKAMNTSVCFDRSKEQQGGAGEQLDISEVSAAERYDTVEMTAAEFAALHPQERSWYRAIRCPGFELPEQDVPVNPYFLGLWLGDESRNQSAIYSNHEEALREFLVSHAAELDMHLVYHGQSAYSTVCNKDRPTNKRIGPANQTQTVRPTIRQTRRTIRQQRLAAEHAAAEYTTQRETASLTPLLESPTSDKHGLLSSVETPGRLSDSVTTELPMSRSASAMRSIRTASGLSEFNDVTNVSASMPDIQNSGIKNQGRIAKVTRQQDSKGEVDFRQQYSQAIKDDLELLETDIEDDVASSDEIEDVCVVGSENELIGSEKQDQSGRRRQIHRLRTGHRGYGDLSDDEQEQLLDSVVERYAGDSRLNTLQQELSKMGILNPETGPINDKKRIPQVFMQNSRSVRLSVLAGLLDSDGWYIYPENMFGFAQSELCHKELFWDVVTLARSLGFGVWTKKRMMPDPTGKRMSPMLVAQISGDLAEIPCVLARKKAMPRLIPQSHSFAIKDISLESEATEWAGFRVDKDQLYLRHDYVVLHNSGFEESMKFKKLTNAQRSGLNQIPNRRFTLWWSPTINRANVYVGFQVQLDLTGIFLHGKIPTLKISLIQIFRAHLWQKIHESVVMDLCQVFDQELEQLGIEAVQKETIHPRKSYKMNSSCADILLFATNKWNVTRPSILFDTKDVYEPTTTNKFWLDVQLRYGDYDSHDIERYVRAKYLDYTTDSMSIYPSATGLMIAIDLAYNLYSAYGQYFPGLKTLIQQAMAKIMKANPALYVLRERIRKGLQLYASESNQEFLNSQNYSELFSPQIQLFIDDTNVYRVTIHKTFEGNLTTKPINGAIFIFNPRTGQLFLKIIHTSVWAGQKRLGQLAKWKTAEEVAALIRSLPVEEQPKQLIVTRKGLLDPLEVHLLDFPNISIRASELQLPFQAAMKVEKLADMILRATEPQMVLFNLYDEWLKTISPYTAFSRLILILRALHVNIDKAKIILRPDKSVITLEHHIWPSLSDEDWMKVEVQLRDLILNDYGKKNNVNVQSLTSSEVRDIILGMEISAPSLQRQQAAEIEKQQEEAKQLTAVTTKTQNVRGEDIIVTTTSQYEQQSFASKTEWRTRAIATSNLRTRANNIYVSSDDIRDEGYTYIMPKNILKRFIMIADLRVQVAGFLYGSSPPDNDQVKEIRTIVMVPQVGNTREVQLPQQLPQHDYLNSLEPLGVIHTISGNEPPYMTAQDVTQHSRLMNAHSSWDKKTVTMTVSFTPGSVSLAAWGLTPQGYKWGAENRDTTSDQPQGFSTSMGEKCQLLLSDKIRGYFLVPEDNVWNYSFMGSSYGSVEKRPVYVKIDTPLRFYDDQHRPLHFQNFAELEDIWVDRSDNFA

SEQ ID NO: 433 - protein, 866 aa, Ferroplasma acidarmanus, taxon:97393 and taxon 261390
  Fac-Fer1 RIR1 precursor
MNKVLNTVIKRDGSSVPFDKKKIAMAIFKAMLSVKIGSMEEANKLADYVAQELETSSEVPTVELIQDTVEKVLMTRRINDVSYIAAAKAYILYREKRNTIRQEKEFIGVKDDLKLSLNAVKVLEARYLFKDSEGKIIETPKQMFHRVAVHLGIIQGLYDYISYRKTGKLNEKGTVYSGITKTQNEELERAFNELKKEKAIDGTYTEFIDFIKTKKNMINYWIEKFENMMIKLEYVPNSPTLMNAGGPLGQLSACFVLPVDDSIDSIFDTLKATAEIHKSGGGTGFSFSRLRASDDIVASTKGVASGPVSFMRIFDVTTDVIKQGGKRRGANMGILNYNHPNIMDFINSKDAENKILSNFNISVGVNDEFFEKLDNDENVDLINPRDGKVTGRVKATTLWNSIIDHAWLTADPGMIFLDEINKKNPVKNIGYIESTNPCVTGDTKIFTSEGVKKARQLYEEGNPLNVKIDGRFGGEFKPSSNVIYTGFKDIYKIQTKEGFEIKVTGDHKIYSEKNGWTEALNLKENEKIRILNEGGSFGSSGTLEEGRVLGWLVGDGHINNGNNNDRAVLNFYSQDRVFADTFRKYVNDIVRPATNNREYNVGMVNIESRNCITIASERLKEFASEYDLIEEKLNVPDKVFAGSMELQRGFLQALFEADGTVYSGQKSRHSVRLGSISLNLLKQVQMLLLNFGIYSRIYQNRKKAGMRMLPDSNREMRLYATQDFHELNISAENLIKYADSIGFISERKNSKLNGAVNSYKKAPVKPSWLARVDKIEYVGREDVYDLVEPSTHSFVANGIVVHNCGEQPLLPYESCNLGSINLAKFVEDGKFTMTGIGKHCVAQILKCVKHNPVDTHIAATGIAGYG

SEQ ID NO: 434 - protein, 838 aa, Ferroplasma acidarmanus
  Fac-Fer1 SufB (Fac Pps1) precursor
MIKMEDYNKDEEIEKLTESLKHNKKSDFEFHDTINPVYSTGTGLNRKTVEEISDIKHEPDWMRRSRLKALDIFLSKPMPTWGPDLSGINFDELTYYSKPGETKAKNWDDVPDKIKETFNKLGIPQMEQKYLAGSVAQYDSEGVYGSLRKEWEDKGVIFTDLDTAVQEHPDLVKDYYCRAIPPSDNKFAALNGAVWSGGSFLYVPKNVTIDMPLQTYFRMNGEQSGQFEHTIVVADEGAKVHYIEGCLPEDELISQGDKFVPINELLTDDSVVSNTGNQRKITRKYVHPYSGLMYKITPLSPGNAFRATSEHPVLSIKKEDVTSRIRDGHYEISTKKLMEAIPEYRRMDELSEGDFIVYVSPVETEDDASIDEDMLKILGLYTAEGSISFNKSLNLYQMSFSFGLSAKEEKIAYELYNIIKEKGERANIFKADKKYYTVSTYSKTLIDFCLNNAGKYADKKAFSEKIMKLPPEKQKLLIDYYLKGDGNVYIKKGKSKMIRAGTASKILALQLQEMLSRNNTFASIMIRKASDDVILGRNIKRKEQYIVEYTENIKFSRVRHKDNYYYVPIKKMEAEVYDDIVYNMEVETDDSYLVKGFAVHNCTAPKYNTSSLHTAIVEIYARKNSDVKYTSVQNWSDSVYNLPVKRAWVDENAHMDWVTGELGSKVTMIYPSSYLRGRGASTSNLQITLATKDTFKDAGGKALHLAPDTTSRIVSKSISLDNGLTAYRGLVRMNEGAKRAKSHVQCDALLINSDSKNYTYPYDEIYEPTAEFSHEATVGKIGTDELTYLRSRGLSEDEASSMIVLGFMDDIMKEIPMEFAVEMNRLVKLEMSKMGAVG

SEQ ID NO: 435 - protein, 890 aa, Frankia alni ACN14a
  Fal DnaB precursor
MAWPVDRSPDVYEHVFESGSAGERGGCVVSVTEISRGGAGGGAEFERTPPHDLPAEQSVLGGMLLSKDAIADVVEVLRMADFYRPAHGLVYEVIGDLYGRGEPADVISVAAELSRRDLLERVGGPGYMHTLISSVPTAANAGYYARIVAEKAVLRRLAEAGTRIVQLAFGAAPDVSDVVDRAQAAVYEVTERRANDDYLPLGELLNPALEEIESIQGRGEGALTGVPTGFVDLDELTNGLHGGQLWIVAARPAVGKALALGTALPTPTGWTTMGRVAVGDMLIGADGRPTRVVAATDVMHGRPCYEVEFSDGSVIVADGQHQWITQTRAEPRRDGPVRSGSRTATLTRPVTTEEIARTLRCRTADRRCTHAVRVAGPFQLPAVDLPVDPYVLGSWLGDETAACASLTSADPEISEEIRRRGHEVVGSTSARHRPGLRRSAATERACTVCGRPFTAAMPGVRTCGQSCGGKLRFLAEPLSVRSCVDCGGRTTGFGPRCRSCHARAGTLQARLRTLGVLGDRHIPAGYLRASEQQRRDLLAGLLDADGTVASNGSTAQFATTNPRLAREVRELVLSLGCRATVTTTRTRGRSEETSTCFTVNFAPQDQVFRLARKAARLRPTGHPAAAVRYITDVRPIASVPVRCVEVDSPDHLYLAGETCIPTHNSTLGLDFARAASIKNGLTSVIFSLEMSRMEITMRLLSAEARVSLQNIRTGRLTDDDWARLARRMGEVAEAPLFIDDSPHLTMMEIRAKARRLKQRNELRLVILDYLQLMSSPKKVESRQQEVSEISRSLKLLAKELDVPVVAISQLNRASEQRADKRPQVSDLRESGSLEQDADAVILLYREDTVEKESARAGEADLIIAKHRNGPTGTVTVAFQGHYSRFVDMAN

SEQ ID NO: 436 - protein, 599 aa, Guillardia theta (plastid)
  Gth DnaB precursor
MKVTKFYNLKAEKHLIIQILVEKDFFLQIYTKIDTQVFYFQSHQILYRSINILHTKKVLINLPNLLSLLHSELVSETVINYLITLFNDRDNFRILNINDSLKVLLDNFIRRELQNSCAKIVSLTFNFNLSVETLLQKSNLLISNINTYNKKVSLKSISQLLLETILEIDKKTNRSTHVLTGFFDLDHILVGLQKSDLIIIAGRPSMGKTAFMLSLVRNVADIQSFPIVIFSLEMSSKQLIYRLISNETNIATSRLREGNISISEWEILNRAMTILSNLNIYLDDENNLDVLDIQSKLASLQQIYGDIGLIVIDYLQLLQYKEKSSQRHIELSYITRYLKLIAKDFNLPLVVLSQLSRNVEFRLNKRPILSDLKESGCLSYATNQPYFLKSDNVNFSKLTSLKVSNHYILSATLELLIPFQYNRIYPIVSLIKRELQTGYKVVYELDFYISVIVSTVEHYVLTLNGWKRILELTVDDLVATLDIQYLIYNNTEVDLFSSNVIFSSVINLICMNRINVYDFWIPKTNNFFVNALLVHNSIEQDADVVLFLYRDSYYQHNLKQSNIDMCEVIVAKHRHGTIGMVNLIFNPNTVSFMNLIKES

SEQ ID NO: 437 - protein, 709 aa, Gloeobacter violaceus, PCC 7421
  Gvi DnaB precursor
MTSSELDLRIEERLPPQNIDAEETILGGLMMDPEALTRVVEHLRPEAFYVESHQIIYRAALALHAQGRPTDLLTLSAWLEDNKLTEKIGGRTYLRRLTDAAINTINIDGYGRLVSDKYALRMLIRAGQEIAALGFDSATEIPKLLDRAEQTLFAVTQERVQRSLVPASEVLMNIFEQLETRYQDGSNVFGIPTHFYDLDNYTQGLQPSDLIIVAGRPGMGKCCAADTPIADPVTGALVTIEEIYRRGEAGKLVEVLTLLGDGRLARVEPSHFVDDGIKPVYRVRTGLGREVKTTLTHPYLTPTGWKPLAEIAAGARIAVPCRIPVFGSESLPPKEISLLCSRATRDNRIPDPVFRLPRAQLVAFLKQLCITADSARVSDRTVEFTSPSKSFCHQLQHLLLRLGVLSALREVSGIFYLDIKPAAETPIKPASLWSQDLAHHCDLHWDEIASIEYVGNEQVYDLTVPVTHNFVAADICLHNTAFSLSIAQRIAQKAGLPAVVFSLEMSKEQLVQRLLCSEAGVESHRLRAARISENEWQRIGQAIGELASIPLYIDDSPNATVTEIRSKARRLQAEQGGRLGLVMIDYLQLMEGAGSDNRVQELSKITRGLKGLARELRVPVMALSQLSRSVEARTNKRPMLSDLRESGSIEQDADIVLMLYRDDYYNPDSPDRNIAEVNIVKHRNGPTGTVKLLFENQFTRFLNLTSGNH

SEQ ID NO: 438 - protein, 1566 aa, Gloeobacter violaceus, PCC 7421
  Gvi RIR1-2 precursor
MFVIAQLHLAPLDAELVIRLFAGASTMGMDGVGSLEQGMALSESQRAVLQKYLIGEERTWEDVCRRVARFVAGAEKTPALQREWQERFFSILAPMKMLPGGSILANSDHGTHGLLNCFVLSAEDNIQEIAKLVTDAVLTTKFRGGVGINIGAHGQKGYIRPKGTPFADGKALGPCAVLDMVSETSKKITTGNKCFAAGTLLHTEQGYVPVEQVVAGVGTRVCTHQGFRNISERFDNGEAEVFRVTTRKGYSVEVTANHKMARLDENGDLLLDELSHLQVGDNLLLLLGSNPVTEKVRLQCIPAGYRSSIEIAQPPELDEQLAYLLGYAYGDGCVGRGATYNYLSLAVSHTYPNVRDQLAAIIREKFGLTTKIYSGSGAVWNLLVHSANLLDWLKANGLLKQKAADLAMPEAILRSPSSVVGAFLSGYFDADGCVRGGKGGYGFDCTSKAFVGAVQLLLLAEGIVSNLHTTDRSRQGWRTIYRLNVCGTEFKRRFQTLCCRSAKVVHSPMVLGRDGTGGYPPALVRGASYQRVVAVGGKHLLYTALLKVIEKTRTAGKQALAESLCQHVNYFPDPIVAIESVGTQRVYDIEVEGMHLLSGNGIYTSNSRRGAFMFSMHWKHPDVWEFIQAKTQSVMDARVARDLIERTADLAVDKGLSDVEKNARLDQLKQELTDTWTETHLSPKGTRDRRWHNANISVLVDDEFFDKLDEGNPGVVDLWNQIAQYAHDTADPGLLLSDNARRRSPIKNFITTTNPCVTADTWVHTGDGPRQARDLIGVQHSTYVNGELFSTTSAGFFATGVKPVLRLRTKEGHQLRLTGNHQVLKLTAQTRHRQYTEWVPAEQLNPGDRVMLHDHRGLQPWDGPGDAETGWLLGTLVGDGCFVRDNNGTLCAKLSFWEASAPEMPGRAVTLATSRANVGRKLAGTINAQGVASVQSSGLARLAATFKIVPGCKRVTSRVEQGSFEFYRGFLRGLFDADGSVQGDQQKGVSVRLSQSDLPTLEAVQRMLLRLGIASDIYKRREAQVRMLPDSRRQSAPYPCKSQYELVIAKDNLQVFAQLVGFEHPAKAARLAKLVDTYSRTPNRERFSATVESLTPDGIEEVYDCTVPGPARFDANGLVVHNCGEIWLPPNSACNLGSIVISKFMHRTERGVELDWEDLARTVEISTRFLDNVLDVAEFATPAQKHNVRNVFRQLGLGIMGWADWLKARRIPYDSEAHLREIDKVGRFIAERAYRTSEALAAEKGACGIWEEIKDVRPGNPFERWRDSTGRVLSGDEAAERAEALTQTPRRNSTVLSIAPTGSIAQLASCSWAFEPDFGLTIWKQVYVDASSSQQNWVQIPSPYVEALGLGEADRQIVLQTGSLQGTAFAAAHPEEAAAFKISREISWQWHVLAQSRWQNWVDSSISKTINCSRETTVEEIKEMYRFAQRNGLKGITVYREGTLESEPVKIGAIDQNEPAAAAQPVAPTADGNGNGYVPARPFATGAARPAMLDEEVSQAASLIGIHYDEGPMYLSEEAPVDDWTSSQFKGGCGGGVLHYQVWIRENGRRLLVVRSDSYSMCFVKS

SEQ ID NO: 439 - protein, 1144 aa, Heterosigma akashiwo virus 01
  HaV01 Pol precursor
MEIIECQVFSFYPTDFLNNRNFTVFAFGRKEDGSSVGIEIVDFKPFMYLHVPERQQKFWTMNNTEDLRKTLVTEHEIKELRNINTVMKKRLFPYTNKDRELFLMLEFNTEWGIRKCSMSLRENYIYKNFDVYESNISPMLRLMHMREILPSGWVRIKNYDQNNTTKCDTNIRINFMDIIGFERDDIAPCKISSFDIECMSFDAYTQNQSIFPSYERENDTISQIGMATWSYGNNEEVLKRLYTLGNAAEPTDQTIDIIQCDNEGELIIRWFHYIAEIDPDIITGYNIFGFDWEYIKGRVDFLGIEDEILSVASRIDKLKSRFMTKELNSSAFGDNEFKFLEMPGRIEFDFFSYIKREHKLESYKLDNVAYHFTKQKKHDVKPMDIFIKLMGTPEDVREVAEYCVQDTFLIIELMKKLCVIPNLIEMSKVTRVPFEYLILRGQQIKVFSQIFYEAMKENIVIPTNILKLQGKKDRNEEHEKYTGATVLTANSGCYFDCVSGLDFASLYPSIMIAYNMCYTTLVLNERELPREAKIETIEWENNRHRFVQNKEGLLPKILKKLWITRKSTKRLMNETENKEMKTILNGKQLAIKVSMNSVYGFCGVMRGILPCVAIASSVTTKGRQMIEHTQNMVKQLYPDAKVIYGDSVTKETPLMLRTMETCGNHKHEVISIENVFTDNMRSIDMYSIIGEKEHVMLSRNEEIWTGENWSRIIRVIRHKTQKKIYGVLTENGYVEVTEDHSLISSDYELLKPKNCIVKETQLLQSFPDIVENSTIENNMIDIPKGQPCRLTVFGQVSAMIIYTYLKRKNYSITLNVCNVNSNKFYISFMERPRFKNTKKNIIKKIFFIRNTDNEEYVYDVETEDGIFHAGIGEIIVKNTDSVYVNFPSTNNDMQKVFDISIEAAEAISKTFPQPIELEFEKVMYPFILFTKKRYASLIWTRVDKPDKIDFKGIQVVRRDNCSYVRESLTTIYNCLLYERNVDKCLGITDKIIDDLLKGRVPIEKLTVSKSLKSNYKSKTMPHFLLAEKMKQRDPMNYPRPGERVPYVFIENTEARLQGEKAENPEYAKENGLIIDTLYYLDHQMKKPLAELFNIVLGEGKYNLYKNHMGFIKMKKNHQERERLREINRKKGQKELNLKWFSKKK

SEQ ID NO: 440 - protein, 1098 aa, Halorhodospira halophila SL1
  Hhal DnaB-1 precursor
MQGDGSASDSEALKVPPHDLEAEQAVLGGLMLDNAAWDQVADRLHEEDFYRREHRLVYRAMGELAEGNHPMDVVTLSGWLRQQGKLEEAGGLSYLGGIARETPSAANIRAYADIVRERSVLRQLIRAGSDVAEAAFRPQGRNSEDLLDYAEQTIFQIAEQTGRNRQGFVGMRQLMPQVIDRIDTLYHTQEAVTGLATGFDDLDHMTSGLQDGDLVIVAGRPSMGKCLAYDAEIVQADGGVKTIEQIVRERRAHLATVGADWRLTWTEPCDYVDDGHKPVFEVTTRLGRRIETTLTHPFLTVHGWQRLEDLAEGDAIGVPRQLPVFGQEPIRDCEVRLLGHLIGDGGLTGSPPRLTSGQEAMTADFLEAVDAFGGVEAKPIRASRRTQSWVVVGAAQARAAARSSFASLVDALIRRSPLTGRAIARNLGVAPATLTYWRQGVNVPDAAMVGLLAGELGVDVGELRPEPVARRNDRNPLQAWLDRLGLAGKSAHEKTVPDCVFRLPREQLARFLNRLFSSDGWVTHLASGQGQIGYTTVSEALARQIQHLLLRFGVLAKLRHRSVRYQDGRRPAWQLDITHAESILTFAEQIGILGKEQRLASVAASVRGRRRQSHTDHIPCEIWQFIDRARGEWTWAELARRAGVASSNIHAYRRGMSRQRLAAFADALGSRELRQLASSDLYWDRIASIRPLGHKQVYDLTIPETHNFIANDVCVHNTTVAMNMVEHVAMQLKKPVAVFSMEMPADALAMRMLASLGRVHLQRVRSGKLQDDDWPRLTSTMSLLAEAPLFIDDSPGLTPTEIRARARRLQREHDELGLIVIDYLQLMQIPGFRENRAGELSEISRGLKALAKELNTPVIALSQLNRSLEQRPNKRPIMSDLRECVTGDTLVLLADGQRRPISELVGSAPEVIAIDDRHRLVPAQAERVWRVGRRPVYRVQLASGRLLRATARHRLLTGSGWKRVDELRDEDRIAIARTVPEPGSVMESESDVFWDHLVAVEPDGEEDVYDLTVPGPASWVADSIISHNSGAIEQDADLIAFIYRDEVYNEDTPDKGVAELIIAKQRQGPIGTVKLTFLGEYTRFENYIEDVYGGGIPG

SEQ ID NO: 441 - protein, 1175 aa, Haloarcula marismortui ATCC 43049
  Hma CDC21 precursor
MATAENTELIDRFEEFYRNYYRNEIGELAQKYPNDQKSLYIDWDDLYRFDPDLADDYRTKPEQIQEYAEEALRLYDLPVDVSLGQAHVRVRNLPESEDIRDLRHEHHGNLVAVRGIIRKATDVRPKVIEAAFECQRCGTLTRIPQTAGDFQEPHDCQGCERQGPFRLNTDQSQFIDAQKLRVQESPEGLRGGETPQSIDINIEDDITGHVTAGDHVRVTGILKLDQRGNDNEKSPMFDIYMEGVSVEIEDEQFEDMEITDADKTEIVELSSEPDIYDKMVGAIAPSIYGYEKEKLAMMLQLFSGVTKELPDGSRIRGDLHMLLIGDPGTGKCVHGDTRVTLADGHERPIREVVESNLDDPKPVDDGVWDTVDFDVPSLQSDGTVATQNATKVWKRKAPETLYRIRTATGRELDVTPSHPLFVQSDGRFQARKAEELESGTHVAVPRKVSTNACNELDVTFRQSQAHNRIDLDLPPQWTPELARLIGYIVAEGYVEQRPDNTGYVSITNNDREVLDDAKSVLETLNLNVTERSSHEGKTARELLCSAGEFVSFLASLDETLLQSSAERRVPQDIMRASDNVVTGFIRGYIEGEGHVSTSQREITVASMSKPLLEDVRTLLVTQGITAQLQPRNNGSYRLRISGQSFHDYAEQIGFITARKTEACRQFEGTHGNTNLDIVPNLGPELRRIREALGLTQSECGLPRSTYQHYERGRRNPSRDSLESVLDAFETRLAEMNNDTPISDTARSDGGGTGSLRQDLNGLAALVEGDIAWDRIESIEPIEHDEKWVYDLEIEGTHNYLTNGVVSHNSQMLSYIENIAPRSVYTSGKGSSSAGLTAAAVRDDFGDGQQWTLEAGALVLADQGIAAIDELDKMSPEDRSAMHEALEQQRISVSKAGINATLKSRCSLLGAANPKYGRFDQYEPIGEQIDLEPALISRFDLIFTVTDKPDEEKDRNLAEHIIQTNYAGELHTHRTENPTSNFSEEEVGTVTEEVAPTIEPDLLRKYVAYAKRNCFPTMTEEAKSRIEDFYVDLRLKGQDEDAPVPVTARKLEALVRLAEASARIRLSDTVDEADADRAVDIAHYCLKEIGVDPETGEFDADVVETGQSKTQRDRIQNIKGIISDIEDEYDEGAPADVVIERAEEVGIDESKAEHEIDKLKQKGEVYEPRTDHLRTT

SEQ ID NO: 442 - protein, 1395 aa, Haloarcula marismortui ATCC 43049
  Hma Pol-II precursor
MREADEQYFETLETQLEAAFDVAERAKERGGDPKPEVEIPTARDMADRVENILGIDGVAERVRELEGQMSREEAALELVEDFVEGTVGDYDSREGKVEGAVRTAVALLTEGVVAAPIEGIDRVELLENDDGTEFINVYYAGPIRSAGGTAQALSVLVADYARALLGIDQYKAREEEIGRYAEEIDLYDKDTGLQYSPKEKETKFIAEHMPIMLDGEATGDEEVSGYRDLERVDSNSPRGGMCLVLAEGIALKAPKIQRYTRNLDEVDWPWLQDLIDGTIGKDEADEGDSAEDANGDDAGEGADDDGGDEADEQAGPPRVEPADKYLRDLIAGRPVFSHPSKSGGFRLRYGRSRNHGFATAGVHPATMHLVDDFLATGTQIKTERPGKAAGVVPVDTIEGPTVRLANGDVRRIDDAEEALAVRNGVEKILDLGEYLVNYGEFVENNHPLAPASYTVEWWEQDLAAAGADVQAMQDSPHIDLADPSAEEAIEWATEYDAPLHPKYTYLWHDVSIEQVCALADAVEDAQVAQADGAYADPEMDGTAGDAHSDDGALVLPRSDAVQQTLEHLLIGHTQDEETITVTDWVPLVRTLGFSRSLERDWTREDLSEHARTYGESESLDAIGVAEDAEREDGQNAIKAINEVAPFQVRERAPTRIGNRMGRPEKSERRDLSPAVHTLSPIGEAGGAQRDVAKATKHADDMSDTPGQVEVEVARRRCPDCGTETHQANCAECSGTTEPVYVCPDCEAEVERDESGRAECGRCETLASPTQYKVLDLQEAYRDALQNVGERETAFEQLKAVKGLTSEEKVPEPMEKGILRAKHDVSAFKDGTVRYDMTDLPVTAVRASELDVSAERLRGLGYTEDIHGDPLTHEDQLVELKVQDIVLSDGAAEHMLQTARFVDDLLEQYYGLERFYEFDDREDLVGELVFGMAPHTSAATVGRVVGFTSAAVGYAHPYFHAAKRRNCFHPDTRLWYEDENDDWEYGTIEELVESRLDDPQEDDFGTLVQELDGDLTVSSLGENGPCRQPVDAVSKHPAPDHLVEVAVGDRTLRVTPDHTMLRAGPDGIEEVPASDLAAGDDLPAYDGGETTTMTARGEASTAATDGAAPTDTVEAVEYVESDVDHVYCLTVADTHRVAVEGTYVGQCDGDEDCVMLLMDGLLNFSKSYLPNQRGGQMDAPLVMSSRIDPSEIDDEAHNMDIMDAYPREFYEATREMKDPTEVEDVMKIAEETLGTDREYTEFRHTHDTANIAAGPDLSAYKTLGSMEDKMDAQLEISRKLRAVVESDVAERIIEYHFLPDLIGNLRAFSRQEVRCLDCGESFRRAPLTGDCRECGGRVNLTVHEGSVNKYIDTAIRVADEFGARDYTKQRLKILERKIESVFENDHNKQSGIADFM

SEQ ID NO: 443 - protein, 1388 aa, Haloarcula marismortui ATCC 43049
  Hma PolB precursor
MRGATLAVKLGYVTRWHILSACGNTPSTAGVFMRHLETRPRMSDGTQGTLGDFGQDADAGTDDRPVADEAAAIAGNGGSDDGDTSVVDLDERQFPPVEETVEFVVTQVDYTIEGQGDDESPVVHVFGRTDDNESVHARVFDFQPYFYAPTDSVTEDGLRQYDSIAGWEEADADGDPYESIRGERLTKIFGQTPRDVGQIRDDFDHYEADILFPNRLLIDKDITSGVRVPARELDDGSLKVHHEEITPVEAHADPRVNTFDIEVDDRQGFPEDGEEPIICLTSHDSYRDEYVVWLYESPDGIDGPEALAGYDPIREDFEADVRVFDEEEAMLEAFVDYIVDTDPDVLTGWNFDDFDAPYFLDRLEELQSYNHDFDLQIDRLSRVDEVWRSGWGGPDIKGRVVFDLLYAYKRTQFTELESYRLDAVGEQELGVGKERYTGDIGDLWEQDPEQLLEYNLRDVELCVELDREQDIIDFWDEVRTFVGCKLEDATTPGDAVDMYVLHKLHGEFALPSKGQQESEDYEGGAVFDPITGVRENVTVLDLKSLYPMCMVTTNASPETKVDPETYDGDTYRAPNGTHFRKEPDGVIREMVDELLSEREEKKAERNSFDPDNPEYERFDRQQAAVKVIMNCFTPDTDVLTPEGVQNIRDLDIGDEVYSLDPETEEMEVKPVVETQSYPDYRGDLVDIETSKMDFRVTPNHRMLVRKNETNGITEDGYSFVEAGDLDDATNYELPHDWDGPDGDPLDTVDLTEYVDDYEVWVRPSVHGHTFAAEIGHYPDTVLKNDIGEEGYVFGPKEFEANREYIESVAERTYIHAESGRKWIPRTFDGDDFLELLAWYITEGNVYTSETKQFGEKTRGASTTVKIAQQAIADGGESDHAAIGDLLDRLGFDYYVDDRSYQFTSALLGDLLCNICGEDSFEKRIPEFVFDLSHRQKRRFLDTLIAGDGDRQKNSWRYTTSSDQLRDDVLRLCAHLGLTANYNRDSGSWRIYVTEDNKNTLRMHRSGSRSTADDGVYCVTVADNHTLMAGRNGKFQFVGQSLYGVLGWDRFRLYDKEMGAAVTATGREVIDYTDEVVANEGYEVVYGDTDSVMLQLGNVGPDDVEGDVEITDEMREKHPEMDDDELELIATTIQKGFELEETINASYDEFAMERLNAQFHRFEIEFEKLYRRFFQAGKKKRYAGNIVWKEGKHVDDIDITGFEYQRSDIAPITKRVQKEVIDRIVRGEDAESIKQYVSDVIEDYQDGNVNYDDVGIPGGIGKKLDNYDTDTAQVRGAKYANMLLGTNFQSGSKPKRLYLDRVHSDFFQRIEEEEGLDPQRDPLYGEFRRDPDVICFEYADQIPEEFEIDWDKMLDKTLKGPIARILEAMDISWEEVKSGQEQTGLGSFM

SEQ ID NO: 444 - protein, 1364 aa, Haloarcula marismortui ATCC 43049
  Hma TopA precursor
MRLIITEKDNAARRIAEILSEGGASANRRNGVNVYRWGNTRVVGLSGHVVGVDFPEEYNDWRDVEPVELIDADVTKEPTQENIVTTLKQLAREADEATIATDYDREGELIGKEAYELIREETDAPVDRVRFSSITEREVRDAFANPDDIDFDLAAAGEARQIIDLVWGAALTRFLSLSARQLGDDFISVGRVQSPTLKLIVDREREIQAFDPEDYWEIFADLQKNGSGFEAQYFYDDDGKEAERVWVEDDADDAYADLTNVDAATVTSVRRRTRTDSPPTPFNTTAFISAASSLGYSAQQAMSIAEELYTTGYITYPRTDNTVYPDDLEEDALLDEFVGAGHFGEDAEALLEQDDITATEGDEETTDHPPIHPTGEIPPKADLSDDEWEIYELVVRRFFATVAEAATWEHLRVVADAGGRSLKANGKRLVEPGYHEVYPYSSASENHVPDVEEGEELAISEVRMEAKQTQPPRRYGQSRLIQTMEDKGLGTKCLTADSDVLVRSENGDIERQTVDSLFSDGQVVLADGDTDIAVSKETPTVLSLDEATERVSEQESTLVSERPLRDDESVRTIETSRGAVTVTDDHPMYIRQDGEVTVRPASDIEAGTDLVAARRPPDTMVEPSDETVLSWETFAADCDKHSKLYGVDCGTELAAQRAARDESQTAFAERYGSYGSAVGKYERGEKDVPVWLLGELDIRPDRIHGLNYETSFENPFPLEWSPELAQVIGCLLGDGSIHRNDDENVVDVRYHNTDEALIERFARDIERLFDIEPTVTDRPGRESHHKRKYQVDVPSAVGRVLVCVLEAVTENGTPGLPDAVRPAFVGALFDDEGHISREGKAFISNTDHTLLTGVGEMLAEMGIETKLAPDQHKLHIRGRRNLEQFLDRIPIASDEKFYRGLDALDAYDVTTRKAELLEAIRQEPKTSAALAQTLGVTRGSVNKYLRELRESGHIEKQIEGSNRSLDENRTVQYVAADFEGSVYATLRGEPSSVTVEDVERREYDGPVYDLTVSENAPNFAVNGGAVVHNSTRHNSIEKLYDRGYIEGDPPRPTTLAMAVVEAAEEFADHVVSDEMTAQLEADMTAIANGEATLDDVADESREMLKRVFDELRDSREEIGEHLQESLKADKTLGPCPKCGEDMLVRRSRQGSYFVGCDGFPECRNTLPLPSTGEPQVLEDHCEEHDMHHVKMLAGRDTFVHGCPRCEAEKADESEDEVIGPCPECGSEHDGDLAIKHLRSGSRLVGCTRYPDCDYSLPLPRNGDISVTEAFCEEHDLPELVIDADSDDPWELGCPICNYEEYQARTAIEDLEDLNGIGSATAEKLGDAGVDSLAALREADPDIVATEVQGVSATQVRDWQDELEA

SEQ ID NO: 445 - protein, 831 aa, Halobacterium salinarum NRC-1
  Hsa-NRC1 CDC21 precursor
MDPDLADDYISHPDQLQEAAEEALRVYDLPVDVSLGQAHVRVHGLAEHTDIRAIRAEHLNTMVSIQGMVRKATDVMPKIQRAVFVCQRCGTDTEVPQGDAGFQEPYQCESCERQGPFKLDPDRSEFVDSQKLRIQESPEGLGGGETPQSIDVHVEDDATGNVTPGDHVTVTGVLRLDQSEEATDSPVFEHYMEGSSVVIEDAEFDELNISEADKEEIVALSDHEEIHEEMVDSMAPAIYGHREAKLAMMLQLFSGVTKHLPDKSRIRGDLHMLLIGDPGTGKCVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHNSQMISYVQNIAPRSVYTSGKGSSAAGLTAAAVRDDFGDGQQWSLEAGALVLADNGVAAVDELDKMADDDRSAMHEALEQQKISVSKAGINATLKARCSLLGAANPKYGRFDQYEPIGEQIDLEPALISRFDLIFTVTDQPDPEEDAALADHILQTNYAGELNTQNEELANANYSEAEIESQTEDVAPAIEPGLLRKYIAYARRTCFPTMTPDARQAIEEFYVDLRSKGADEDAPVPVTARQLEAIVRLAEASARLRLSDSVEKSDADRVIGIVQSCLQDIGVDPETGEFDADVVETGQSKTQRDRVKNIKALIGEIEEEFDDGAPVEEVLDRAEEIGMDAGKAEHEIEKLKERGELYQPNTDHLRSI

SEQ ID NO: 446 - protein, 1370 aa, Halobacterium salinarum NRC-1
  Hsa-NRC1 Pol-II precursor
MRPTDETYFETLETGLDDAFEVAEAARERGEDPTPNVEIPVAKDMADRVENILGIDGVAERVRDLDGEMSREEAALELVADFVDGRVGDYDTDAGKIEGAVRTAVALLTEGVVAAPIEGIDRVEVNDNDDGTQYVAVYYAGPIRSAGGTAQALSVLVADYARAMLGIDAFKPRDDEIERYAEEVDLYDSETGLQYSPKDAETTFITEHCPVMLDGEATGNEEVDGFRDLERIDTNSPRGGMCLVLAEGIALKAPKIQRYTRNLDEVAWPWLQDLIDGTIGADDADEDTPDAGSDSDATDEGDAPSASTDAEEPPRAAPSDKFLRDLIAGRPVFGHPSKNGGFRLRYGRARNHGNATAGVHPATMHLLDDFLATGTQIKTERPGKAAGIVPVDSIEGPTVKLANGDVRHINDPADALDVRNGVAEILDVGEYLVNYGEFVENNHELAPASYAPEWWIQDLDAAGADVQALRDSPYVDLTAPTADQAMAWATDYDAPLHPAYTYLWHDIDVEQFRALADAVADAHTDASDDDDRGVLVLDHTTTVRETLEALLVTHHQGDDTIRVDDWLPLARSLGVTESLDREWETLSEAAAEWPNAVRAVNEVAPFSVQERAPTRIGNRMGRPEKSESRDLSPAVHTLFPIGDAGGSQRDVADAARYAPDMSDTPGEIPVRVGDRVCPSCDEHTYESRCPDCGDWTDPHYECRDCGAVATPDESGRVECPNCGRDLDNVTTQVIDINDEYHGALRAVGERENAFDQLKGVKGLLSAEKTPEPMAKGVLRAKHDVTAFKDGTVRYDMTDLPVTAVTPAELDVTAGQFRELGYNQDIHGDPLEHDDQLVELRVQDVVLSDGAADHMLKTADFVDDLLTQYYGLDAFYDLDDRDDLVGELVFGMAPHTSAAVVGRVAGFTSASVGYAHPYFHAAKRRNCFHPETNVWFRDESGEWHHDPIETLVEARLDPDTADEDDFGALVQALDGDVFVPSVTEDGEETLQRVEAVSKHPAPDHLLAVETKRGRELTVTPDHSMRRWTGDGIERVDARELTAGDALPAPTQVPGDGETATSELRSESLDGTHPQRRFGDGGSVRTDEVVSVEPVRSSVDHTYSLTVAETNTLVANGLFTGQCDGDEDCVMLLMDGLINFSKSYLPDKRGGRMDAPLVMSSRIDPAEIDDEAHNIDIDREYPREFYEATRELADPEDVADLITLAESTVGTDEEYTGFGHTHATSNIHLGPSLSAYKTLGSMMDKMDAQLELARKLRSVAETDVAERVIEYHFLPDLIGNLRAFSRQETRCLDCGEKYRRMPLSGDCRECGGRVNLTVHEGSVNKYMDTAMRVATEYDCREYTKQRLEIMDRRLESVFEDDTNKQSGISDFM

SEQ ID NO: 447 - protein, 1365 aa, Haloferax volcanii DS70
  Hvo PolB precursor
MTYIDKCLSVVPGAVRGNAGVFSRAAEAIAMTQTGLTDFGGNDTDGAGDARPDEEAAIVAGDAGQHVSDVVDTDEVRFPDPDGTVELAVTQVDYTIEGAGRDEYPVIHIFGRTADDETEHVRVLGFRPYFYAPTDSLDDGDLDKDVITGTEDGYESIRGEELTKIFGRTPRDQGQIRDEFDHYEADILFPNRLLIDKDIKGGVSVPERRLDDGTIQIPHQEVAPAEVDANLRVNTFDIEVNDRNGFPEEGEEPIICLTSHDSYRDEYVVWHAVADEGLGKRPDTLPNYDFLGEDGDVEVRTFDEEAAMLDAFLTYIEETDPDILTGWNFEDFDAPYFLDRLEEVDERTDLNLDYNRISRLGEVWRGGWGGPDIKGRVVFDLLYAYKRTQFTELESYRLDAVGELELDAGKERYSGDIGDLWEEDPERLLEYNLRDVELCVEIDRKQDIIAFWDEVRTFVGCKLEDAPTPGDTVDIYVLHKVHGEFALPSKGKQESEDYEGGAVFDPITGVKENVTVLDLKSLYPMCMVTINASPETKVDPERYDGEMFRAPNGTHFQQEPDGMIREMVDELLTEREEKKSLRNSHDPGSSEYEQFDRQQAAVKVIMNSLYGVLGWDRFRLYDKEMGAAVTATGRKVIEFTEQAANQIGYDVAYGDSVTGDRPVVVRDPGGTVRILPIEDLFARGTTESEVLIAADGDVVASATPGKTRRALDGWDALSVNEDGEAEWQPIAQAIRHNTDKPVVNLQHKFGESTTTRDHSYVVPGEDGLTTVSPDDVAEPYRVSGVPDVEPVEQVDVYEVLRGYEREYEDGRSVGSDNSITKRKQIHADDEYVWFGHEHHRDVDSTVKVKRFVDIDSEDGAALIRLLGAYVPEGSASTGETATSKFGASLAESDREWLAQLQRDYSRLFENTTAGIITSDRRAERTVEYQTDTGGASVTYNDETLKLQMMNELAAVFFREFAGQTSRGKRIPSFVFHLPEEKQDLFLTLLVEGDGSREFPRYTEAYAQRNFDFETTSRELAAGLSMLLTQRGQKHSLKYRDSKDSYTIRTCSTYREGRDPVLTEADHDGYVYDLSVEENENFVDGVGGIVLHNTDSVMLELGPDVSKQEAIEQSFDIEEHINAAYDDFARDELGADEHRFQIEFEKLYRRFFQAGKKKRYAGHIVWKEGKDVDDIDITGFEYKRSDIAQITKEVQKNVIDMIVHGEETEVINDYLHDIITDFESGNLPLEQAGIPGGIGKRLSAYETPTAHVRGAQYANAFLGTNFGRGSKPKRVYLKKVHPSWFREMETGEFDPQVDDLYREFKRDPDVICFEYADQIPAAFEVDWDTMLTKTLEGPISRVIEALGMSWDEVKSGQEQTGLGSFM

SEQ ID NO: 448 - protein, 852 aa, Haloquadratum walsbyi DSM 16790
  Hwa GyrB precursor
MSHETEYGAGDIQVLEGLEAVRKRPAMYIGSTDSRGLHHLVYEVVDNAIDEALAGHCDQIDVTLHEDGSVSVADNGRGIPVDTHEQHDIPAVEVIMTVLHAGGKFDNKSYQVSGGLHGVGVSVVNALSRWLEVEIKRDGALWRDRFEYGEPQPGAFERVRDLDPDEETGTTIRFWPSDDIFETTEFEFSTLENRLRELAFLNSGVEICINGETDDINSKFCFNGGIREFVKYLDETKTVLHDSVVHYQNEQDGIEVEVALQATEELQGSIHAFANNINTREGGTHLTGFKTALTRVINDYGREHNLLDGFDSLQGEDVREGLTAVVSIKHPDPQFEGQTKTKLGNSDVRGIVESTTHERLGTYLEENPDVAKVIVRKAVEAAKARKAAKQAEELTRRKSALESTSLPGKLADCQSRDPAESELFIVEGDSAGGCFSGDTEIALASGDSITFESLVDAYERGETHYCYTIGDDGRIRIEEIMNPRVTQEDAALLAVTLDNGEVIRCTPDHEFMLRDGNYCEAQNLTDGQSLMPLYRTTTEMTETTETTETTGTAEMVKQPFAQNNWESVSQLANRYNRRHTTTDHIVETQQIQSQQQSQIETVQISERADVHNHTVISVESLTETADVYDLEVPVTHNFALASGVFVHNSAKQGRERRFQAILPLKGKILNVEKHRLDRILENDEVRALITAIGAGIGDEFNVEDARYNRLIILSDADVDGAHIRTLLLTLLYRHMRPLVEAGYVYAAKPPLYRIRYNGNTYDAMTKSERDQVISDVCNGNPTQVQRFKGLGEMNPEQLWETTMNPENRVLKQITIEDAAAADKMFSVLMGDAVEPRKEFIKDRATDAEWVDI

SEQ ID NO: 449 - protein, 2216 aa, Haloquadratum walsbyi DSM 16790
  Hwa MCM-2 precursor
MAQAPQDPQDLTDRFIQFYRKYYRDDIGTLAQQFPHEKRSLYIDYHDLYAFDVELAEDYRREPDQLREYAEEALRLYDLPADVKLGRAHVRMRSLPDTVDIRNIRVHDDHIGHLIAVQGIVRKATDVRPKITEAAFECQRCGTMTYIPQSDSGFQEPHECQGCERQGPFDVDFDQSEFIDAQKVRVQESPEGLRGGETPQSIDVDLEDDATGAVTAGDHVTTTGVLHIEQQTSGNEKTPIFDIYMDGRSVEIEDEEFDDMDITDEDVAEIVELSNDPDIYEKMVESVAPSIYGYDEEKLAMILQLFSGVTKHLPDGSRIRGDLHMLLIGDPGTGKCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHNSAMLQYIRNIAPRSVYTSGKGSSSAGLCVTGETRIHTTDGFVPLKQLATQHHPKKVTTETAAAYERELYTVDPTTQSAEVTQSKSSHVWRMPEKHCRRIRTASGKQLEASVNTPVLTVDDAEIKWKPISAIESNDSVVIPQYNNVERSSVSITDIFEFTQEQLKLTEKSITILRTEIVSQYQNIAAAADALNIDVNSVEALITGQPVVSDVIDRVCDAISVSSEDITIHHVIGPTGTAIELPEVLNDDLLYLLGAAFACGNIMTGETCEERWIQFHAPEESIRSHIIDAAVATFGSESIQTDTEQANTVQVISATVTRLFETLGLEQITDAAPREIHPRLTAVSGADAFIRGLFDTGGRIDNKNTPQIAIGTASEPLAEQIQLLLETYGIGSCRDTGDQSHTGTSTTQGQYLTLTGSDAQAYRTTIGTRTDSGSSWDRQVSSSHADSEPSVRSTTTDTRKRTDMHEHEIISAGDVSTVSSVESDGGTPQMPRSNIEPQSIGYDYESSRVNEIQTETVVEAVNTGKKEVFDLTVPNTQNFIGGGIVTHNTAAAVRDDFGDGQQWTLEAGALVLADKGIAAVDELDKMRCVTGETLVSLADGRHVPIASLATDASKTGTIESKPDGVGRTIRGIDDLTVWTMTENKQLTGRPVTAIHQYDSPDTLWQITLSDGSEVTTTADHPFIIINRDGVHECPAKHLSENDEVYTPADGYTASTSDITPDSETSSDSLPDGGITQTRTNQYSSHRCDADLSDDELLDITTKTIKSIETVHPSDGTDVYDLTVSGTHNFVANGMIVHNSEDRSAMHEALEQQSYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHNSISVSKAGINATLKSRCSLLGAANPKYGRFDQYEPIGEQIDLEPALISRFDLIFTVTDEPDPDADAKLADHIINTNYAGELHTQKANIPNSEFTDGEVESATAEVTPTIDAELLRKYVAYARRNCYPTMTDDAQDVIRKFYVDFRAKGADDDAPVPVTARKLEALVRLSEASARLRLSDTVEQEDAKRVTSIVESCLRDIGMDPETGEFDADIVETGTSKNQRDRIKNLKHLIENIEADYDDGAPVDEVIEQAISELGLSESKAEGEIENLRAKGEVYEPRTGSLRTT

SEQ ID NO: 450 - protein, 2216 aa, Haloquadratum walsbyi DSM 16790; identical to SEQ ID NO: 449
  Hwa MCM-3 precursor

SEQ ID NO: 451 - protein, 2216 aa, Haloquadratum walsbyi DSM 16790; identical to SEQ ID NO: 449
  Hwa MCM-4 precursor

SEQ ID NO: 452 - protein, 2216 aa, Haloquadratum walsbyi DSM 16790; identical to SEQ ID NO: 449
  Hwa MCM-1 precursor

SEQ ID NO: 453 - protein, 2289 aa, Haloquadratum walsbyi DSM 16790
  Hwa Pol-II-1 precursor
MRDADKQYFETLESHLEQAFARARQAKGQGYDPKPEVEIPVARDMADRVENILAIPDVAERIRELDDERSREEVALELVTDFVEGTVGDYDTREGKIEGAVRTAVALLTEGVVAAPIEGIDRVEILSDDDGSEFVNVYYAGPIRSAGGTAQALSVLVADYARSLLDIDEYSARTDETERYAEEVSLYDRETGLQYSPKDKETKFITKHMPIMLDGEATGNEEVSGYRDLERVDTNAARGGMCLVLAEGIALKAPKIQRYTRQLAEVEWPWLQDLIDDTIGSDEHSNNSVKNGEADIVKTDKDTNESETEDGIDNDDYNDSGLEPANSPRADATNKYLRDLIAGRPVFGHPSAAGAFRLRYGRARNHGFATAGVHPATMHIVDDFIATGTQLKTERPGKAGGVVPVDSIKGPTVRLANGDVRCINDPEEAEKLQNGVEKILDLGEYLVNFGEFIENNHPLAPAAYVFEWWIQEFEASNADVQALRDDPTVDLESPTFENAMRWAKKHDIPLHPAYTYLWHDISVTEFDHLADAVAAGEITMNEVSDTNSASGNTSLRANTNTDDTLTIDTTPAIRETMERLLIEHHQDSDSIHIPAWRALALSLGIKIESDNDTGIGDRMWSLTDLSKHARKQDDGKSAIAAVNEVAPFQVRERAPTRIGSRMGRPEKSEDRDLSPAVHTLFPIGEAGGNQRNLSDAAQSFGDNTERGQISVQLGKRRCPYCETVGFELQCAECGRHTEPQFVCRECESVLSPDESGRVHCDRCERDVTSAEWQDIDLHQRYRDALDRVDERESSFEILKGVKGLTSSNKTPEPLEKGILRAKHGVSSFKDGTVRYDMTDLPVTAVRPKELDVTAAHFRELGYQTDINGNPLQFDDQLVELKVQDIVLPDGAAEHMMKTADFVDDLLEQFYELNQFYQIDERDDLIGELVFGMAPHTSAAVVGRIVGFTSAAVGYAHPYFHAAKRRNCFHPETKIWFRDTDNEWHHETIQTFVEDRLDDPEIDAVGTLVQEVDDNTDREISVPSIDDNGNERLQSVTAVSKHRAPNHLVQIETISGREITITPDHEMHIFEQGNLVSKQASKITSGEYAVIPKRLQTISPSSHTPQHDLLREFLTRDELTADRLIIHTSDPVRLCNRVFPEEVTSCKDAVEIMQNTACHLDKNKETLIGWLGEGRIPVALLRGFVETDEALLMSIPDDVQIGLRGEKVRIDRHIGFTEELTSLLGYYAAAGIVHTQTNPISYESAQQEQSRITFYNIDTQTQTDLLNALNSVFEIEPIQYNLDGEILGVPGELIRRVFDTVFDVGTQPSHKRIPQALFDASESHITSYLRCFFSTHDSLTTDTRDISATTVSREFKEDIIAALRRLGITAEVTTQQSRSVPEVLPDWYAIDDITHHDADNSLNLTRSYVISIASSDAVTLQRDRQAQEQIKYDAQGLIANNNAIHQSRQVTDGGRKDYITEPITDIEYVDADIDYTYCLTVSETHSLIVNDLSQKQCDGDEDCVMLLMDGLLNFSREYLPDKRGGSVAADSRLVAVSPDDKIVFTTIEDFWKKLNTPIERNGKFRKRTCVSEGWQTYAFDENHEASLRPIEKAIRYTADESEQLRRITTQLGRSLDITDEHSLFRYDDGIEEVAGDDLTAGDIIVAPRTLDVEVTQTTLDLSEYIHDNERCPSEQTGSGELNLASKSAISDSRNKETPGVTHNILPQRSKFTDEMTTLSPTAVGGLESEQNETLRVGESTGAIERYINVDDSFGWLLGQFIAQRSISTDALTMTVHTAAEKHAERIVATSDSVFGIKPTVNSIERGYEIVFPSVFDTIVSGLTAKEQSEPEQDVDHTHTDEIGIPECILHAPDDIVLSFLQGFILAENAQRKGNAASEASEMVSESETTVTLETPSVGVKDGLVFLCHRLGVITDISEKSGEEYSVHFEESRYTVSIATEGKTNPLDQILNGERPTMPEGVSVPVPDALLTIHESIANSPHIDQVIPDTVVQQETVSLETLQSLLTGLSTVDLPAQLEAKRDELTLLTEGDLSYLRVESVECVDYDGYLYDLQVGGEPVFTANWLYAHNSMDAPLVMSSRIDPSEIDDEAHNMDIVRQYPREFYEATRRMEDPDEWEEEVTIAEEYLDTDNEYTGFNHTHDTTDIAAGPDLSAYKTLDSMMDKMDAQLELARKLRAVDETDVAERVIEYHFLPDLIGNLRAFSRQQTRCLDCGESYRRMPLTGECRECGGRVNLTVHEGSVNKYMDTAIHIAEEFDCREYTKQRLEVLERSLESIFEDDTNKQSGIADFM

SEQ ID NO: 454 - protein, 2289 aa, Haloquadratum walsbyi DSM 16790; identical to SEQ ID NO: 453
  Hwa Pol-II-2 precursor

SEQ ID NO: 455 - protein, 2142 aa, Haloquadratum walsbyi DSM 16790
  Hwa PolB-1 precursor
MPKFLANSAKTVDMKQAGLSDNWSDAADSGAGTSNARPDAEALAVAGKDTQHVSAIVDADEVRFPDADGSVELLVTQVNYSVERAGHEEYPVVHIFGRTADDTAHHVRVLGFEPYFYAPTESLNDDLLDNDAITRTESGYESIRGEELTKICTRTPRDVGQIRDDFDHYEADILFPNRLLIDKDIKSGIRVPARRLADKPQTIQIPHTEIEPVDVEANLRVNTFDIEVDDRSGFPEDGEEPIVCLTSHDSERDEYITWLYNAPNAAEDTDPPDSLDRDDSIRSDTTADVRTFNREDAMLDAFVSYIEQTDPDILTGWNCLPSDARIQMADGTETEIHAVEIGDNVIGTTDQRSVTATVTNKWKSEREIYEFSLADGTSLRSSGDHRIMISDSNTVDWKSGSDIEQGEYVLKPRQLPVDDPTIPIINNLLSSESANIIDTLEVDALDSTGRSMNIHSSNPRESIAHTATLSMADGGDQKQRNETTNNTLDLNRTVTKQDLYAIGRVLHNRITPRQDGITPVSQATLIDNSVLSSPSPANTQHQSDSILTEVISSLRGLVSPGAHAIDFSAIYEMPKSHIAQFLAGTLDGSETGETTSSNLTVTTESASIARWYAQLYRRLGIYAQYQADAVHIANNACDLQRLSDAILPRLRCSDTIDYVKTQIDTVCDSSLKHSRASSTGLSGDEANIRQFSDDGPQNKSYAAQPDSSDYDDDWNAYVFVEIEAITLNGTETTYDIETTTHNFVADDCLVHNCDDFDVPYFLDRMEVINPQSEYTLTSERFSRIDEVWRSGWGGPNIKGRVVFDLLYAYKRTQFTELESYRLDAVGELELDVGKERYPGDIGDLWEQDPQQLLEYNLRDVELCVEIDRKQDIIAFWDEVRSFVGCKLEDATTPGDTVDIYILHEAHDRFALPSKGRTDAEDYEGGAVFDPATGVKEMVGVLDLKSLYPMAMTTINASPETKVDPKNYDGDTFRAPNGTHFRRSPDGIIREMIDDLLAEREEKKSLRNEYDPGESVYEQYDRQQTAVKVIMNCFTPDTNVLTPNGVRNIRDLTVGDSVYSLNPETMQMEIKPVTQTHEYPDYQGDLIDIQTNEIDFRVTPNHRMLVEATGTDTTSTNDYDFIEAGNLDISSRYELPHGWSVDHTDSLGAYIDLITLLREQSDTYNVLSDGGMTTAATADINHNNVTRRVDSDTFVSLIGWYVATGRVSRTQNGSDRVYLQLSQTNTKARTQLTMLLDELGVDWQADNEKIHFVSHVWTELFDTTCGRTEKNKHIPELIFDASASQKRAFFDAIINGSGVKNDDSYQYHTSSEDLRDDILRLCVHIGIVARYDYINDESWRIECTETANPDFTLTHSGRQSTAEDGVYCVTVADNQTLLAGRNGTFQWTGNSLYGVLGWDRFRLYDKEMGAAVTATGRDVIEHTADAASDLDKSVIYGDSVTGDRPVVVRDPSDYIQIVPIKLLFEQATAPEQNMRLTADGAPSVNSELPKERRHLDQWEALSLSDTGETEWQPINQIIRHQTDKEILTLQHEYGESTTTRDHSYITADDGEYVETSPENVDEPLPIPNIASVKTIETIDIYQTLTTDTQAQIGNDTEPDKWLPSADCIHANDEYVWIGTTDKQQDRDDSTPAIPRYIDLTSDTGHALIRFLAVYLSDWSKSTITTTERGQCLHITGPQESALKTCAADADQLFTHITPSIAVDAESNTNTVDSGFRCHIPTTLATTLISAFAGHPAHTKQIPSIVYHLPAAEQSLFIRHLIQAESTPESDGVSGRPQKSDKPILLENEFITTNRELAAGVSMLLTQCGQSYTISKQDTKGAYTIHINNSSSSGCTPTLTETTHSGYVYDLSVATNQNFVDGLGGLVLHNTDSVMLELGDDITEQEAIEQSFEVEEYINDSYDEFAREELDAVRHRFEIEFEKLYRRFFQAGKKKRYAGHIVWKEGKDVDDIDITGFEYKRSDIAPITKEVQRRVIEMIVHGEGTDSISEYLTDIINDFESGNVPLEDIGIPGGIGKRLESYDTATAQVRGAKYANEFLGTNFGRGSKPKRVYLRKVHPSWFREMETDSKFDPQRHGLYREFKRDPDVICFEYEDQIPDAFAVDWDLMLEKTLKGPIERIIEALGMSWNEIKSGQEQTGLGNFI

SEQ ID NO: 456 - protein, 2142 aa, Haloquadratum walsbyi DSM 16790; identical to SEQ ID NO: 455
  Hwa PolB-3 precursor

SEQ ID NO: 457 - protein, 1909 aa, Haloquadratum walsbyi DSM 16790
  Hwa RIR1-1 precursor
MDTHDVDADELELPIKRTTGETIEQRLTDNAYHNILPARYLRKDAKGDLAESQEEIFERVAQNVALAEAVFEADKQDTEITVTPDQLKPDHPRRDELAEEVFGAGADAADTVTTTLSVYNVNKFAYETIVPELPDEVQHHVKSVADEFEDLMSRLSFMPNSPTLMNAGDELQQLSACFVDSPSDDISDIHQTAKEAAEVFQCLTADSTVMLKEKGMVSVSEVETGDQIAQRSDTGFQYKPVEETHAYENAETLTVTLTNGCSIRGTPNHRLMVDDEWTRIDEIQPDQEVHYTLGWLRETNQSPPKLHSQSHTTVNQTADSISPDSSEPIELSESENADTGNRHNSAVAVKQSRTQTQLISDEVVSRPEHTRRPDQLSEELAELLGLWIDTGLWHQSGVQFNVERENIAEYIDQLSQQLFDTPAAISDTDGTYTVDITDHKLKEWWKANFGGKPDGTQSSYVPQMIKEAPTNVIEAFLRGCFTAEGGLRKDMRPRLCTSSEDSIDDIAVLMMGLGYPVEKSVIRNADGEPYYSVMPATDDGLSAFLHDVGFIDERREIGLSNIESSDSRALNNTHKIEVESIVESPPATVYDITVADNHEYVTDGIISHNSGGGMGYAFWKLRPYGDSVGSTGGIASGPITFMRTYDQMCETIAQGGARRGAQMGVMRISHPDVIQFIHAKNKDVSLAHSLRLNDPDDFTHTSFADALEEARELIDEEGRVPEHLRNAVEGHLSNFNISVGVTDEFMEALFADEEFTFTNPRTEDPHIATPETKELYELHDLGEHVEVGEELSVPAEELWDHIVSGAHENGEPGVIYLERVNKEHSFDVEKHSEHEILATNPCGEQPLEEYEACNLGHINLSTLADKDAPDWRVWYDNNGDAYNNLDDAAEAFIYEAIDMNAFNRRIESGTRFLENVVTMSDFPVDEIEATVRDMRKIGLGIMGLAQLYIQIGVRYGSQEANAIAEQLMTHINHESKWASHELAKERGTFNDWTESKYANPTEYREWFEHHTGLDASEWEDGFLIRNHNTTTIAPTGCVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHNTTSMIGNTTGGCEPIYNVAYYKNVSDDVQGDEMLVEFDDYFLRVLEQNDIDVEAVKQEAQEQMANNDFDGVDGLDTVPKAIGELFVVTSDLSGKDHAGVQCACQEGIDSAISKTCNFPSSATKEDMDEVYRYIYQNGGKGVTVYRDGTRSKQVLTTRAQNTEFADESEAAETLVEQIEDVFGDVDSFLDNDTVRATVDDEIDRVLAAADGNVELGKKRPRPDVLHGVTQRIDTGYGKLYVNINEDDAGRPFELFANIGNSGGFTASFTEALAKTVSTALRSGVDPREIASELQGIRSPKVAWDKGEQINSIPDAVGTAMRRYLDGEIEKGYPQQQNLTEVGTDTGSEPRVESGSGSDAKAPGHETDGGAAVTDDTVSTNRNNGSLPSANDENNDTDDVDSLVAAGESPECPECGSMSLYYSEGCKTCESCGWSEC

SEQ ID NO: 458 - protein, 1909 aa, Haloquadratum walsbyi DSM 16790; identical to SEQ ID NO: 457
  Hwa RIR1-2 precursor

SEQ ID NO: 459 - protein, 637 aa, Haloquadratum walsbyi DSM 16790
  Hwa rPol A'' precursor
MTETITDASEYEHITDDIAAIVDDYNLPESLQHRIYETIEERGEVPIEKVDDIAQAIASRYEDSRVDAHDPVGTVSAQSIGEPGTQMSIEADESIVIRRDGETELTEIGSFVDTILAADNQETRITDGHEIALAPNGLEVPSLDTDEQIRWKHIEAVSRHASPDEILLIELESGRSIRATKAHSFVTRRDGDVLPVAGETLVVGDVLPTVGSYDHASGSISVPLQSQSVAADGGTVEPNTNITANAERDSASITSAGIIGSATWERISSIETVAPEYEYVYDLSVSGLETFTTGEGVVTHNTMNTFHYAGVAEIDVTQGLPRLIELVDARKTPDTPTMTVYLEEEYANERPRAHEVVWQMEATKILALGDISTNVADMLVQVDLNAETLNERWPTIGDSDLIAEEVQDIIENNLGVSTRREKMLIEFGPSEPSYRRLLQLVEELRDIVFKGLEDISRVVIRKEDNERTNGEEFVLYTEGSALGDVLPIEGVDASRTTSNNIHEVHRNLGIEAARESIINETMETLREQGLDDVNVRHLMLVADIMTNRGEIESIGRHGISGSKDSVLARAAFEVTVNHLLDAAVHGEEDDLEGVIENVIVGKPVAIGTGDVDLRMGSIDADSGRSANSGGSPELSDD

SEQ ID NO: 460 - protein, 1304 aa, Haloquadratum walsbyi DSM 16790
  Hwa Top6B precursor
MTSFQSTLGEEGEIADELAESQRAISIAEFFEKNKHMLGFDSGARGLVTAVKEAVDNALDATEEAGIKPDISIEIRESGDYYTLIVEDNGPGITREQVPKVFGKLLYGSRFHAREQSLTPTQTLLIRRDGDVTFTSIGDFCDSYLPADGPASAPIPVDANIEVPSFDRATHEMTWQPVTNAIRHRTDERVYRISTACGRTLEITGNHSLFSLSSDNETIEVNAGELSPGDSILAPKQLPMASESVDTSTTVDEKTQSSTGAQTQRINILEHIKPDDLKESAATFRIHEADQASLSSGGNHKSPSASLASSQLASSEVIASAGGQQIQSSADQRQSKGHTPGGDHHNNECLLIKSVCENDKMSTVADYTLEIVTPDGESSRLPVSVSIDNVFITSLVRYIATASTSDISPVSDSSVDYTTEERHNTVDRSFSDTMRPLDSVIPLICEDDGEIELPSFVFESDPKRQQQLLTQLYRYPEASNGRNAGDDTVTYTTTSATLARQLTTLWNMNGVVATTNTQTETSQSDEIENESAQTTIYEVSVDRAEIETDIAGSDSDCQQGDGDLCLVSVSSVEEIDAPPYVYDISVPGASGHDENFVTANDGAICVKNSRGQQGIGISAAVLYSQLTSGKPARITTRTQSSDTAQYFELIIDTDTNEPEVSADQERDPGAASLSPTHGTRIELEMEANMRARGQLRDYVKDTAVVNPHARITLDEPGLEEPRQYERVDGAELPAQTEEIRPHPHGVELGTLLKMLEATESYSVSGFLREEFTRVGSKTATKILDQFRDRHFGRALPMSAPETIPDNADGTDDEQVTSSLESIIEAAVVNKGASATTTFASRVAETVNQRSGTTQGELVGIVDTVAEDIEDEFETTFGTTVRENAVEAAWDVLTTDIDEDIYPLVADATSTQKDHETVRGVTDRIATKFADGSEPLRATRDAVREYVDRSADMIVSEEVSFGETARENVVDAVWTAMQTVDDELPAVKAVADDRNIASDLLEAMRLTDILAPPTDCLSPITADLVEAGLRKEFDADFYAAATRDAEVHGGDPFIVEAGIAYGGELEGGKISLLRFANRVPLVYQRGACATTDVIKSIGWRNYGLDQPGGSGMPNGPAVVMIHVASTNVPFTSESKDALANIPAIEDEIELAVREASRELKSYLNKRRSMQKRREKQDVLGRILPEMANKLADVTENDRPDIDNALARIMNNVSVERNVDNGSVTLTVQNYSDRQESPTLTDIVDSKPDTIPDEIEIVELEDEYFLTWEPVVDAGESATVTYEVPTGASFELDVDDVETEKLTIDA

SEQ ID NO: 461 - protein, 959 aa, Invertebrate iridescent virus 6; identical to SEQ ID NO: 414
  IIV6 RIR1 precursor

SEQ ID NO: 462 - protein, 593 aa, Kazachstania exigua, formerly Saccharomyces exiguus, strain CBS379
  Kex-CBS379 VMA precursor
ISQSLSKYSNSDAIIYVGCFAKGTQVMMADGTDKSIEDIQLGENVMGKDGTPRTVISLPRGKETMYEVCHSSIKGTTNETLMNYVCSGNHKIVMQTPQQIGITEHAIDGKTYTSVSYFALRDSQDGYPIVKKLTKSFEHQQNGGKEQTLITVNNFVASLKSEPINWDVEAKHYESLGHYVKKCSYQLINPVFHQSGKLAQEIASLNYSKDKAPLLAWLIGFWVGNGAMRHSQFVIDSQDIELVNRIQEIATLLNLSATTACYYSGSVDDQDKLAKLNTATGEGFEDDLQSNPTAKELADMDILSESKTATLPTAFGVEKIDELIISLGEGRGNGNVFAQVIGSFGIDLADKDTLVSKIAHELAGDAFEVREQFVAGLVDATGYVRKDVYDHASEATVSIESKSTVLGLVKIARSLGIKIVVTSNDYQDPEDHDHGHDHGSCGHDEVATGYTAVMTGDALTNSMRFCAIGRNRVTAKQFMRQAIPFYFSLEKKSEDDYYGITVPDNTDKQYLLSSMALVHNCGERGNEMAEVLMEFPELFTEINGRKEPIMKRTTLVANTSNMPVAAREASIYTGITLAEYFRDQGKNVSMIAD

SEQ ID NO: 463 - protein, 978 aa, Kluyveromyces lactis IFO1267
  Kla-IFO1267 VMA precursor
ARKELKRVTLEDHEESEYGAIYSVSGPVVIAENMIGCAMYELVKVGHDNLVGEVIRIDGEKATIQVYEETTGVTVGDPVLRTGKPLSVELGPGLMETIYDGIQRPLKAIKDISQSIYIPRGIDAPALSRTIKWQFTPGKFKVGDHISGGDIFGSIFENSLLDDHKILLPPRARGTVTWIASAGEYTVDEKILELEFDGVKYDYSMYHTWPVRVPRPVTEKLSADYPLLTGQRVLDSLFPCVQGGTTCIPGAFGCGKTVISQSLSKYSNSDAIIYVGCFSKGTEVMMGDGKDELIENIQVGDEVMGRDGLPRQVVGLPRGHDDMYQVTEKSEDNETAKISFQCNSSHKLVLVTPQDIRLTESKEKVTVAFNRLADISVGNGTESRTVRLVERAEKSFANAESNQAIINAAEFVTTIDTTSIEWTLEARDMLLVDSSIREVTQQLINPVLLEKEHLAGVLKSNDFQSSLAPQFSYLLGAFVGSSGKDNSEYLQQLSAQFDKKIVAEKSIDVQSNGKTVGTASIVISQEPVQENKRRKVAQVSLVSKIVQESFSSGIPSFMMSENINVRESFLAGIVDSQNQKLDDTVALKTLSVKTHDGIARLARSLGIRVSGKKQNQEYTLTLSGDALKSVSNWTSTSNIEKVDVIHKAQPISFDLEKIESADYFGVTLAEESDHKFLLSNMTLVHNCGERGNEMAEVLMEFPELFTEISGRKEPIMKRTTLVANTSNMPVAAREASIYTGITLAEYFRDQGKNVSMIADSSSRWAEALREISGRLGEMPADQGFPAYLGAKLASFYERAGKAVALGSPDRIGSVSIVAAVSPAGGDFSDPVTTSTLGITQVFWGLDKKLAQRKHFPSINTSVSYSKYTNVLNKYYEKNYPEFPVLRDRMKEILSNAEELEQVVQLVGKSALSDGDKITLDIASLIKEDFLQQNGYSTYDAFCPIWKTYDMMKSFISYHDEAQKSVSNGANWAKLSEAT

SEQ ID NO: 464 - protein, 1027 aa, Kluyveromyces lactis NRRL Y-1140
  Kla-NRRLY1140 VMA precursor
MAGALENARKELKRVTLEDHEESEYGAIYSVSGPVVIAENMIGCAMYELVKVGHDNLVGEVIRIDGEKATIQVYEETTGVTVGDPVLRTGKPLSVELGPGLMETIYDGIQRPLKAIKDISQSIYIPRGIDAPALSRTIKWQFTPGKFKVGDHISGGDIFGSIFENSLLDDHKILLPPRARGTVTWIASAGEYTVDEKILELEFDGVKYDYSMYHTWPVRVPRPVTEKLSADYPLLTGQRVLDSLFPCVQGGTTCIPGAFGCGKTVISQSLSKYSNSDAIIYVGCFSKGTEVMMGDGKDELIENIQVGDEVMGRDGLPRQVVGLPRGHDDMYQVTEKSEDNETAKISFQCNSSHKLVLVTPQDIRLTESKEKVTVAFNRLADISVGNGTESRTVRLVERAEKSFANAESNQAIINAAEFVTTIDTTSIEWTLEARDMLLVDSSIREVTQQLINPVLLEKEHLAGVLKSNDFQSSLAPQFSYLLGAFVGSSGKDNSEYLQQLSAQFDKKIVAEKSIDVQSNGKTVGTASIVISQEPVQENKRRKVAQVSLVSKIVQESFSSGIPSFMMSENINVRESFLAGIVDSQNQKLDDTVALKTLSVKTHDGIARLARSLGIRVSGKKQNQEYTLTLSGDALKSVSNWTSTSNIEKVDVIHKAQPISFDLEKIESADYFGVTLAEESDHKFLLSNMTLVHNCGERGNEMAEVLMEFPELFTEISGRKEPIMKRTTLVANTSNMPVAAREASIYTGITLAEYFRDQGKNVSMIADSSSRWAEALREISGRLGEMPADQGFPAYLGAKLASFYERAGKAVALGSPDRIGSVSIVAAVSPAGGDFSDPVTTSTLGITQVFWGLDKKLAQRKHFPSINTSVSYSKYTNVLNKYYEKNYPEFPVLRDRMKEILSNAEELEQVVQLVGKSALSDGDKITLDIASLIKEDFLQQNGYSTYDAFCPIWKTYDMMKSFISYHDEAQKSVSNGANWAKLSEATRDVKHAVSSSKFFEPSRGEEEVHAEFEKLLTNIQDRFAESTD

SEQ ID NO: 465 - protein, 903 aa, Kineococcus radiotolerans SRS30216
  Kra DnaB precursor
MTAYDEPPADFDAPDDGPSRGRRGGRKDRGADGGGASFDRMPPQDIAAEQGVLGGMMLSKDAIADVVEVLKGNDFYRPAHELVYEAILDLYSRGEPADPVTVSAELTNKGELTRIGGTPYLHDLISTVPTAANAAFYARIVRERAVLRRLVEAGTRIVQMGYGADGMDVDAIVNSAQAEVYAVTETRTKEDYAVLGDVIEGTIDEIEASSHRGEGMVGVPTGFADLDSLTNGLHPGQMIVIAARPAVGKSTLGLDIARAASIKHGLASVIFSLEMGRNEIAMRLLSAEARVPLQKMRKGNMDDADWTRFARTMGAINEAPLYIDDSPNMSLMEIRSKCRRLKQRADLKLVIVDYLQLMTSGKRVESRQQEVSEFSRALKLLAKEIEVPVIALSQLNRGPEQRTDKRPMVSDLRESGCLTAGTRVLRADTGAETTMGELFALQARDVPVWSLDESLRYVRRHLTRVFPTGVKPVFRLRTASGKTVRATANHPFLTYDGWKPLGELSVADRLAVPRHVPAPERVASWTDDQVLLLGHLIGDGSFVKRQPLRYASVDEANLSAVTEAAANAFSIVAVRDEYAAARCTTLRLPAPYRLTHGRRNPLAAWLDELGLFGLRSYEKFVPQEVFHLPKRQIALFLRHLWATDGSVTLTRQSRGGRIYYASTSLQLIQDVSRLLLRFGISTRVRTTTPKGDHRPGYTLDVSGVDDQRRFLQEIGVHGARGATADRLLEVIRDVSANTNVDTVPRQVWDDVRRLLVEKEMTHREFAAAMGTSFGGSSLWKHAPSRERLGRVAQVLDSAELDVLAVNDVLWDEVVAIEPDGEEQVYDATVLGGHNFVADGIAVHNSIEQDADMVILLHREDMYEKESPRAGEADFIVAKHRNGPTDTITVAFQGHYSRFVDMAT

SEQ ID NO: 466 - protein, 953 aa, Listonella pelagia phage phiHSIC
  LP-phiHSIC helicase precursor
MAFELRPYQKEAVKKVIEHVKICLDPCVVDAATGCHAYGHDIMMSDGTKKQVQDIAVGDKVMGPDGNPRKVIRLVKGQDEMFRVTPTKGESFVVNGGHILSLYQTPRRAGQTPGYTEISVNEYIRSSSTFKHRSKLQRFGFDLPGKNLPIPPYILGLLLGDGCITGVGQMSFTSQDHAAITEIERYLMSIGASNRLHFDSREAVGVCFRDYHRLEDHLTELGLYGRNSGDKFIPSEYLTSSNEDALEMIAGLLDTDGSLCPHGVYDYISKSRELSEGLVYLCRRVGLAAYISECEKSCQNGFKGTYYRVCVSGDLSKVPCRVSHKKCIFDRKQKKRVDVTGFKVEPIGVGDYYGFTVDGDHLYLDGDFVRHHNCGKSVIIAEIAKFFNEVSGKKTLVIGPNKEICQQNAEKYKSYGFPASFWSASIGKKEMRHQVVFGSPVSIKNELDKFGPQFGAVIIDEAHLLSPTVKEICSHMKEQNNLLRIVGLTATPYRLGSGYIYEYDDNNNPVGDECTKNPFFKRLVYRITAKELIDQGFLTPPIADHEMASKYDTSGVQLNKRNQFDAKDIEQAFEGQGRLTAQIIADVVSHCQNKMCCMIFAATIQHAQEIMESLPKHNSYCVTGKTKRKDREKAIERAKTGEIKYLVSVGTLTTGVDITNVDVIAILRATESASLLQQIIGRGLRLHENKTTCLVLDYAENIERHGLEDDLFNPDIRVSGGGDGSAKVNALCKSCGTVNEFTLRKGCDLDHIDEYGYALDLAGERIEMEGQPMPAHYGRRCYGGDVINGHYVRCSERWSMKVCPECEVENDIAARYCTSCRTELVDPNEKLKADYKRMKRDPRAISTDKMLGWECKPWITQRGNNTLRVDYRSEYRSFTIWYSPDSSNVKAQGLWNNLSEVVFGKGHIAPTPEAFCDALKRGFGTMPETVTVQKQGDFFRAFAHGLPEDDKPE

SEQ ID NO: 467 - protein, 795 aa, Mycobacterium avium
  Mav DnaB precursor
MAVVDDLTSGMDSSSPSEDFGRQPPQDLAAEQAVLGGMLLSKDAIADVLERLRPGDFYRPAHQNVYDAILDLYGRGEPADAVTVAAELDRRNLLRRIGGAPYLHTLISTVPTAANAGYYATIVAEKALLRRLVEAGTRVVQYGYAGAEGADVAEVVDRAQAEIYEVAERRTTEDFVPLEDLLQPTMDEIDAIASNGGVARGVPTGFTELDEVTNGLHAGQMIIVAARPGVGKALALDTPLPTPTGWTTMGDVAVGDELLGDDGRPTRVVAATDVMLGRPCYEVEFSDGTVIVADAAHQWLTETRVSRKSAQAAAVGYNRYKNQRTFAAVRTTAEIAETLRCPAQDRRLNHSVVNARALELPDREFLVPPYTLGAWLGDGTSAAAQITAADPEIIMRIEAEDSGAGVGTLQARLRTIGVLGNKHIPTEYLRGSEAQRRALLAGLLDTDGTVTVGGAVQFSVTNQRLARDVNELIVSLGYRCQTSTKRVQGRSETSSIAYTLTFSTADKVFALERKAIAHKERRAVTGTSRGGSRFIVDVRPIEPVAVRCVEVDNDSHMYLASRAMVPTHNSTLGLDFLRSCSIKHRMASVIFSLEMSKSEIVMRLLSAEAKIKLSDMRSGRMSDEDWTRLARRMSEISEAPLYIDDSPNLTMMEIRAKARRLRQKADLRLVVVDYLQLMSSGKKVESRQLEVSEFSRQLKLLAKELEVPVVAISQLNRGPEQRTDKKPMLSDLRESGSLEQDADMVILLNRPDAFERDDPRGGEADFILAKHRNGPTKTVTVAHQLHLSRFANMAR

SEQ ID NO: 468 - protein, 795 aa, Mycobacterium avium 104; identical to SEQ ID NO: 467
  Mav-104 DnaB precursor

SEQ ID NO: 469 - protein, 875 aa, Mycobacterium avium subsp. paratuberculosis str. k10
  Mav-PT DnaB precursor
MAVVDDLTSGMDSSSPSEDFGRQPPQDLAAEQAVLGGMLLSKDAIADVLERLRPGDFYRPAHQNVYDAILDLYGRGEPADAVTVAAELDRRNLLRRIGGAPYLHTLISTVPTAANAGYYATIVAEKALLRRLVEAGTRVVQYGYAGAEGADVAEVVDRAQAEIYEVAERRTTEDFVPLEDLLQPTMDEIDAIASNGGVARGVPTGFTELDEVTNGLHAGQMIIVAARPGVGKALALDTPLPTPTGWTTMGDVAVGDELLGDDGRPTRVVAATDVMLGRPCYEVEFSDGTVIVADAAHQWLTETRASRKSAQAAAVGYNRHKNQRTFAAVRTTAEIAETLRCPTQDRRLNHSVVNARALELPDREFLVPPYTLGAWLGDGTSAAAQITAADPEIIMRIEADGVVAVPSGSAPYRYQLRLPPGAEQAPRRCVVCGKSFIPQTSQVRTCGRSCGGRARFMSDPVPSPTCVRCGGPSAGMRLCLKCHSTVGTLQARLRTIGVLGNKHIPTEYLRGSEAQRRALLAGLLDTDGTVTVGGAVQFSVTNQRLARDVNELIVSLGYRCQTSTKRVQGRSETSSIAYTLTFSTEDKVFALERKAIAHKERRAVTGTSRCGSRFIVDVRPIESVAVRCVEVDNDSHMYLASRAMVPTHNSTLGLDFLRSCSIKHRMASVIFSLEMSKSEIVMRLLSAEAKIKLSDMRSGRMSDEDWTRLARRMSEISEAPLYIDDSPNLTMMEIRAKARRLRQKADLRLVVVDYLQLMSSGKKVESRQLEVSEFSRQLKLLAKELEVPVVAISQLNRGPEQRTDKKPMLSDLRESGSLEQDADMVILLNRPDAFERDDPRGGEADFILAKHRNGPTKTVTVAHQLHLSRFANMAR

SEQ ID NO: 470 - protein, 874 aa, Mycobacterium bovis subsp. bovis AF2122/97
  Mbo-AF2122 DnaB precursor
MAVVDDLAPGMDSSPPSEDYGRQPPQDLAAEQSVLGGMLLSKDAIADVLERLRPGDFYRPAHQNVYDAILDLYGRGEPADAVTVAAELDRRGLLRRIGGAPYLHTLISTVPTAANAGYYASIVAEKALLRRLVEAGTRVVQYGYAGAEGADVAEVVDRAQAEIYDVADRRLSEDFVALEDLLQPTMDEIDAIASSGGLARGVATGFTELDEVTNGLHPGQMVIVAARPGVGKSTLGLDFMRSCSIRHRMASVIFSLEMSKSEIVMRLLSAEAKIKLSDMRSGRMSDDDWTRLARRMSEISEAPLFIDDSPNLTMMEIRAKARRLRQKANLKLIVVDYLQLMTSGKKYESRQVEVSEFSRHLKLLAKELEVPVVAISQLNRGPEQRTDKKPMLADLRESGCLTASTRILRADTGAEVAFGELMRSGERPMVWSLDERLRMVARPMINVFPSGRKEVFRLRLASGREVEATGSHPFMKFEGWTPLAQLKVGDRIAAPRRVPEPIDTQRMPESELISLARMIGDGSCLKNQPIRYEPVDEANLAAVTVSAAHSDGAAIRDDYLAARVPSLRPARQRLPRGRCTPIAAWLAGLGLFTKRSHEKCVPEAVFRAPNDQVALFLRHLWSAGGSVRWDPTNGQGRVYYGSTSRRLIDDVAQLLLRVGIFSWITHAPKLGGHDSWRLHIHGAKDQVRFLRHVGVHGAEAVAAQEMLRQLKGPVRNPNLDSAPKKVWAQVRNRLSAKQMMDIQLHEPTMWKHSPSRSRPHRAEARIEDRAIHELARGDAYWDTVVEITSIGDQHVFDGTVSGTHNFVANGISLHNSLEQDADVVILLHRPDAFDRDDPRGGEADFILAKHRNGPTKTVTVAHQLHLSRFANMAR

SEQ ID NO: 471 - protein, 846 aa, Mycobacterium bovis subsp. bovis AF2122/97
  Mbo Pps1 precursor
MTLTPEASKSVAQPPTQAPLTQEEAIASLGRYGYGWADSDVAGANAQRGLSEAVVRDISAKKNEPDWMLQSRLKALRIFDRKPIPKWGSNLDGIDFDNIKYFVRSTEKQAASWDDLPEDIRNTYDRLGIPEAEKQRLVAGVAAQYESEVVYHQIREDLEAQGVIFLDTDTGLREHPDIFKEYFGTVIPAGDNKFSALNTAVWSGGSFIYVPPGVHVDIPLQAYFRINTENMGQFERTLIIADEGSYVHYVEGCLPAGELITTADGDLRPIESIRVGDFVTGHDGRPHRVTAVQVRDLDGELFTFTPMSPANAFSVTAEHPLLAIPRDEVRVMRKERNGWKAEVNSTKLRSAEPRWIAAKDVAEGDFLIYPKPKPIPHRTVLPLEFARLAGYYLAEGHACLTNGCESLIFSFHSDEFEYVEDVRQACKSLYEKSGSVLIEEHKHSARVTVYTKAGYAAMRDNVGIGSSNKKLSDLLMRQDETFLRELVDAYVNGDGNVTRRNGAVWKRVHTTSRLWAFQLQSILARLGHYATVELRRPGGPGVIMGRNVVRKDIYQVQWTEGGRGPKQARDCGDYFAVPIKKRAVREAHEPVYNLDVENPDSYLAYGFAVHNCTAPIYKSDSLHSAVVEIIVKPHARVRYTTIQNWSNNVYNLVTKRARAEAGATMEWIDGNIGSKVTMKYPAVWMTGEHAKGEVLSVAFAGEDQHQDTGAKMLHLAPNTSSNIVSKSVARGGGRTSYRGLVQVNKGAHGSRSSVKCDALLVDTVSRSDTYPYVDIREDDVTMGHEATVSKVSENQLFYLMSRGLTEDEAMAMVVRGFVEPIAKELPMEYALELNRLIELQMEGAVG

SEQ ID NO: 472 - protein, 790 aa, Mycobacterium bovis subsp. bovis AF2122/97
  Mbo RecA precursor
MTQTPDREKALELAVAQIEKSYGKGSVMRLGDEARQPISVIPTGSIALDVALGIGGLPRGRVIEIYGPESSGKTTVALHAVANAQAAGGVAAFIDAEHALDPDYAKKLGVDTDSLLVSQPDTGEQALEIADMLIRSGALDIVVIDSVAALVPRAELEGEMGDSHVGLQARLMSQALRKMTGALNNSGTTAIFINQLRDKIGVMFGSPETTTGGKALKFYASVRMDVRRVETLKDGTNAVGNRTRVKVVKNKCLAEGTRIFDPVTGTTHRIEDVVDGRKPIHVVAAAKDGTLHARPVVSWFDQGTRDVIGLRIAGGAIVWATPDHKVLTEYGWRAAGELRKGDRVAQPRRFDGFGDSAPIPADHARLLGYLIGDGRDGWVGGKTPINFINVQRALIDDVTRIAATLGCAAHPQGRISLAIAHRPGERNGVADLCQQAGIYGKLAWEKTIPNWFFEPDIAADIVGNLLFGLFESDGWVSREQTGALRVGYTTTSEQLAHQIHWLLLRFGVGSTVRDYDPTQKRPSIVNGRRIQSKRQVFEVRISGMDNVTAFAESVPMWGPRGAALIQAIPEATQGRRRGSQATYLAAEMTDAVLNYLDERGVTAQEAAAMIGVASGDPRGGMKQVLGASRLRRDRVQALADALDDKFLHDMLAEELRYSVIREVLPTRRARTFDLEVEELHTLVAEGVVVHNCSPPFKQAEFDILYGKGISREGSLIDMGVDQGLIRKSGAWFTYEGEQLGQGKENARNFLVENADVADEIEKKIKEKLGIGAVVTDDPSNDGVLPAPVDF

SEQ ID NO: 473 - protein, 765 aa, Methylococcus capsulatus Bath, prophage MuMc02
  Mca MupF precursor
MTLPAADLKAIFNLEPKAAIAYLQHKGYKLTWNWQEMLDDAHARAFTIAKAARLDVVQDIRNALDVALRHGQTLKDFQKNLKPTLQAKGWWGKQIIVDGAGNAEVARLGSPWRLATIYRTNLQSAFMAANYQEMAEATDSHPYWQYVAVLDGRTRPSHRAMNGRVFRHDDPIWNTIWPPNGFNCFPAETPVRAAARLGLKTWYAGKVVELQTRLGHRLTLTANHPVLTVRGWIAACQLQKGDQLIGDASGVNPRLAGVVNDEQPPARAEDLFQTLAAQGFRIVPMAPHDFHGDAGLRKPEIHIAGPDVHLMDEVQAAPGQFVGQQQLRRADACAIMDADRPDGPPPARMILADAVAPQNPADVAEAGAELAADGAFGDQPVAVQGQHPAFEMGVAVAGALPGGGALASNGGGVLFDGSPFDALGFRAPPQGDVAGTEQPAQGVTAASGLVRQLLEANAGLIALDEIVQIRQFDWAGHVYDFETETGLIMAGGVIVHNCRCRVRPRSERSLARDGIAWQSSAGKLRTLETDAGVDKRTGEITHARRTGIDVVDADGKKHFFAPDAGFNFNPGQGWSKPFTPPPLDTLPKTFSPGQVLPDLPKPEKFAASMIVPDGLGEEDYAKAFLAEFGADLGKPVVFQDVTGDPMLIDEALFKSGAGEWKATKDGRGPYMRLLAHAIRSPDEIWMRWEESRERPGTWLLKRRYLKTFEIDGHGSESPQYGLSVFEYGSEGWSGSTAMISQASRGPGARRRYIERQRDGFLLFRR

SEQ ID NO: 474 - protein, 1317 aa, Methylococcus capsulatus Bath
  Mca RIR1 precursor
MEPQAISLEVLREKYARHGETCAEEIFARVADALAAAEESPDEWRPLFFSALESGFIPAGRIMSAAGTGMQATLINCFVQPVGDSVSEETDGKPGIYTALAEAAETMRRGGGVGYDFSAIRPRGARVHTTESRASGPVSYMRVFDRSCETVESAGSRRGAQMGILRCEHPDIFEFVRAKDRPGELTNFNLSVALNEDFMRAVETDGPWELTHRAEPSPEQQCEGAYLREDGLWVYRSVPARELWELIMRSTYDHAEPGVLFIDRMNRENNLSYCERIEATNPCVTADTWVMTASGARQVRDLIDRPFEAVVDGECHPTESRGFFFTGDKPVLRLSTAEGHTLRLTANHPVLRVSKMTRQLRETEWVKAGELRPHDKIVLHDHRALPSWDGAHTEAEGYLIGLLIGGGTLTRDKAILSIWDAAAPKVANGGGSVPAAGVAGVMRAAELAARTLPHRTDFNGWQTTMEGRGEYHMATGALHTLALELGLTPGDKRLTAPLETTSSAFHRGLLRGMFDADGSVQGSQRKGVSIRLPQTDLGNLQTVQRMLLRLGVASTIHQNRRPGGTKVLPDGEGGAKGHSCQAAHELIISGENVVRYAERIGFADSDKMDRLTALLQRYRHTRHAERFIATVQSLEDDGMEAVYDVTVADVHAFDANGLYVHNCAEQPLPAYGCCCLGSLDLTRFVSRPFTPEAAFEAERLAEVATIAVRMLDNVLDTTYWPLARQRQEAQAKRRIGLGFTGLGDALAMLGLRYDSAAARDMAAGIARRLRDAAYLASTALAREKGAFPLFEAEPYLASPFVAGLPEPLRARILESGIRNSHLLSIAPTGTISLAFADNTSNGIEPPYAWTYLRKKREPDGSTREFPVEDHAYRLYRATAGDRPLPPAFVTALDISALDHMRMLAAVQPFVDASISKTVNVPADYPYADFQHLYLEAWKAGLKGLATYRPNPVTGAVLEATPTHGISRPEFDESDPDRRLRLDEVPAPALASLRWRRRPRPAAGNPAWSYLIDHPLGSFAVFIGHIEDHGNHPFEVWVTGAEQPRGLGALAKSLSMDMRSNDRGWLKTKLESLMKAHGDDGFDLPFPPNGRPVRVPSLVAGFARLIYYRCAELGAFDTLADTPVVDALMSPKEPKTGPDGTLSWTVDILNVATGDDFVMGLKELVLPNGQRRPYSMWLSGEYPRVLDGLCKSLSFDMRVIDPAWIGAKLRQLLDFPEPRGDFLARMPGTGRQRNYPSTVAYMAQLAIHRYAMLGLLDEQGRPLQDMGLMDYESAGPETGEAKPPVLKGARCPECGNDAVIRRDGCDFCTACGALGGCG

SEQ ID NO: 475 - protein, 423 aa, Mycobacterium chitae
  Mch RecA precursor
REKIGVMFGCFNYSTRVQLADGTTEKIGKIVNNKMDVEVLSYDPVADQVVPRKVVNWFNNGPAEQFLQFTVEKSGGNGRSQFAATPNHLIRTPAGWSEAGDLIAGDRVMASEPHRLSDQQFQVVLGSLMGDGNLSPNRRDRNGVRFRMGHGAKQGDYLQWKTDLLANIAHSAHENAKGARFVDFTPLPELAELQRAVYLGDGKKFLSEEYLKALTPLALAIWYMDDGGFTVRSKGLQQRTEGGSGRIEICVEAMSVGSRDRLRDYLRDTHGLDVRLRHAGAAGKAMLVFTTAASAKFQEIVAPYMAPSMEYKLLPRFRGQGTVAPQFVEPTERLVPARILDIHVKPHTRSMNRFDIEVEGNHNYFVDGVMVHNSPETTTGGKALKFYASVRIDVRRIETLKDGTDAVGNRTRAKIVKNKVSPP

SEQ ID NO: 476 - protein, 1059 aa, Methanoculleus marisnigri JR1
  Memar MCM2 precursor
MTEEITVEVTDNVGEWTKFLKKQYKRELAELSREYPHNHSLLIDYRKILNNKLAFELLRSPGKVLGDIRDAIVQNKLLKLKDGQDPDLVNIRFTNLPQKTNVRDIRADQINTFVSLEGILRKTTEVRPRIVSAVFRCRTCNKNTDPVPQGYGRFDEPDFCPNCERKTRLDLVMNRCRFVDAQKLRIQESPEGLRGGEQPQTLDIDVTDDLTGMVSPGDRVVVNGILRSVQRVNYGQKSTLFDIYLECNSIEVAEKEFEEVSISEEDEANIMALARDPMVYKKIARSIAPTIYGTDDVKEAIALQLFGGIAKDMPDGSRLRGDVHVLLVGDPGIAKSQILRYVVKLSPRGIYTSGKSSTSAGLTATAVKDEFGDGRWTLEAGALVLADMGIAAVDEMDKMQKEDRSALHEAMEQQCYDDETEVLTESGWKLFRDVTADDRVATLSADGRLEYAPPSNFVASEYDGEMYYVKSRQVDLAVTPNHRMYVNLNRRADEWEGFRLIRMDELPIHKRMRFKKNAAWTGERHETHWIPPVVKFANQNAEGKLTDPITVGMDDWLEFLGYFLSEGSVQRHHQTGVPYRVIISQTNPESAETIRQCLERLPFRFSYDGKNFSINAKQLAEHLAPFGKCHEKYVPDYAKSLPPEQIGILLDALMLGDGYINKTTGVSIYTTSSRRLADDVTELLLKKGLSGNVYLRREAGTVAANPRGGTSTATHDIFQVTFIRDGQNEPNINTNGKQHIEKRPYKGTIYCLEVPNHTLYVRRSGIPVWCGNSISVAKAGITATLKSRCALLGAANPKLGRFDQFVPIGEQINMPPSLLSRFDLIFVMTDQPEVQRDGAIAQHIIKTHSVGELIKQHEYEPLPDVDDAYIERALAPVIPDIDPTLLRKYIAYAKRTCFPILSDGAKEALIAYYMRLRNLASGNKPVPVTARQLEALVRLAEASARMRLSNTVDTEDTDRILKIVDACLRQVAYDAESGSFDIDKLVTGVTKSQRDIIRSVKEAIRNVSGDSGGQARVDEVIEILLQQGFSRDKIEHTLEQLKRGGEVLEPRHGLVKLIG

SEQ ID NO: 477 - protein, 1285 aa, Methanoculleus marisnigri JR1
  Memar Pol-II precursor
MEVSPAIARYFEELEGELDAAIRLAAAARARGLDPRTEIEIPVASDLADRVEALLGYKGIAARIRELEAEMSREEAALRIGDDFAARKFGETTPEEILDHAIRAAMALLTEGVVAAPTEGIGKVSLGKNDDGTDYLKIYYAGPIRSAGGTAQALSVLVGDYVRQALGINRYIPRPEEVERYIEEIRQYNNIMSLQYLPSEKELRMIIENCPVCIDGEPTEQQEVSGYRNLERVETNTVRGGMALVVAEGLALKAPKVLKNVRKMKMEGWDWIEEMIGGGPKSDDDDASAAIKPKDKYIRDLIGGRPVFSYPMRKGGFRLRLGRARNTGFAAAGFNPATLHILGDFLAVGTQMKVERPGKAAGVVPVDSIQGPTVKLRSGEVRRVDDAAEARRLAGQVDEILDVGEMLVSFGEFMENNHPLMPPAYCEEWWMLEGGPRHPENELEAIEFALDGVPLHPDYTYMWDDVAPADIARLAEAVGTGGTVEDGVLMIRNTPETKAILEELLIPHHLSGDRLAIREHLAFLACLGLTLQLTKRPAWQDAPMENSLDLVMHLSGFTVRSRAGTRIGGRMGRPGKSKPREMRPPPHSLFPIGDEGGARRSFQAACSSKPRSNTDGGVIEAEVGERQCPACGAFTYKNLCECGAHTNPVFRCPRCGKDVGQDVCPRCNAETVCLQKVTINVKAEYLAAMESLGVRESSVALLKGVKGLISRERPVEPIEKGILRALQNLYVFKDGTVRYDMIDLPLTHFRPDEVGVPIERLRELGYTHDTYGRELVSDDQVLELRHQDILVSEGCGEWLVRVAKFVDDLLVRLYGLEPFYKAEKPLDLVGHLLMGLAPHTSAGVLVRLIGFSKAPVGYGHPFFHAAKRRNCFAGDTEITVSDGRRWMSLPIRQFVTENFDISKPGLDHVGTFYSDPRQPFYVRSIDSQGKTSLKRVTSVSVHRAPAHLVRFATRRGRVLTVTPDHAMLVWDTDYLRKIKALEVAVGDRVPVEEGGLVVADEVVSRETVQALDDRVYCLTVAENHTLVANGIFCGQCDGDEDCVMLLLDGLINFSRAYLPETRGGTMDAPLVLTTRIDPSEVDKESHNVDVCDHYPIEVYNGCLAYAHPKDLDAFVDRVERRLGTPAQCEGFLFTHQTSNISAGPLESTYTRLGSMLDKLEAELDLAKRIRAVDEDDVAERVLNTHFIRDLQGNLNAFSKQKVRCMKCNAKYRRMPLAGKCTRCGGHVIPTVHEGSVKKYLEMSRNICATYAISDYTKQRVEVLFMQIESTFGEPPEKQLGLADFM

SEQ ID NO: 478 - protein, 422 aa, Mycobacterium fallax
  Mfa RecA precursor
REKIGVMFGCFSYGTRVQLADGSTEKIGKIVNQKMDVEVMSYDPVTDQIVPRKVVNWFNNGPAEQFLQFTVEKSGGNGRSQFAATPNHLIRTPAGWTEAGDLIAGDRVLAAERHLLSDQQFQVILGSLMGGGNLSPNLHDRNGVRFRMGHGARQADYLEWKTALLGNIGHSVRENDQGARFVDFTPLPELGELRRAVYLGDGKKFLSEDYLKALTPLALAVWYMDDGSFTVRSKGVQQRTQGGSGRIEICVEAMAEGTRERLRDYLRDTHGLDVRLRSAGSGKSMLTFSTEATAKFQELVAPHMAPSMEHKLLPRFRGLGTVEPRFVEPAQRLVPARVLDVQVKPRTRSMNRFDIEVEGNHNYFVDGVMVHNSPETTTGGKALKFYASVRMDVRRIETLKDGSDAVGNRTRVKVVKNKVSPP

SEQ ID NO: 479 - protein, 554 aa, Mycobacterium flavescens Fla0
  Mfl GyrA precursor
RGIFRPDRSHAKSARSVAETMGNYHPHGDASIYDTLVRMAQPWSLRYPLVDGQGNFGSPGNDPPAAMRYCVTGDALVRLPFGQSVRLRDVVAGARSSSDNAIDLKVLNRHGDPVVADKLFHSGEHETYTVRTAEGYEVTGTANHPLLCLVDVGGVPTLLWKLTEEIRPGDHVVLQRTPPTEFGPADWQDAFEALHLGAFISEGFVSENRAGFNNLDREFFNAVLTAYDTIVGGPRYVSSRTIASDSLLHELDVHNLTALKKSRLGELVGQRSADKAVPEWLWKAPAVVKRVFLQALFEGDGSCSALPRNTIQVSYSTRSGRLAKDIQQMLLEFGVISRRYVHATGEHKVVLTSRAQAELFAAQIGFGGIKQAKLQGLLDALPQAAAGRDGDYVPGLAQFVRKHSGSRWVDKDWLNRHNIDRLSRWQRDGAEILGRIADPDVRAIAQELTDGRFYYARVASVTDSGVQPVYSLRVDTDDHSFITNGFVSHNTEARLTPLAMEMLREIDEETVDFIPNYDGRVQEPTVLPSRFPNLLANGSGGIAVGMATNIPPHN

SEQ ID NO: 480 - protein, 423 aa, Mycobacterium flavescens, ATCC14474
  Mfl-ATCC14474 RecA precursor
REKIGVMFGCFNYSTRVQLADRTTEKIGKIVTQKMDVEVLSYDPDTDRVVPRKVVNWFNNGPAEQFLQFTVEKSGGNGKSQFAATPNHLIRTPGGWTEAGDLIAGDRVMATEPHRLSDQQFQVVLGSLMGDGNLSPNRRDRNGVRFRMGHGAKQVDYLRWKTELLGNIKHSTRVNDKGATFVDFTPLPELAELQRAVYLGDGKKFLSEEYLKALTPLALAIWYMDDGAFTVRSKGLQERTAGGSGRIEICVEAMSEGTRVRLRDYLHDTHGLEVRLRQSGKAGKAVLVFSTASSAKFQELVAPYMAPSMEYKLLPRFRGQSTVSPQFVESTQRLVPARILDVHVKPHTRSMNRFDIEVEGNHNYFVDGVMVHNSPETTTGGKALKFYASVRMDVRRIETLKDGADAVGNRTRVKVVKNKVSPP

SEQ ID NO: 481 - protein, 550 aa, Mycobacterium gastri
  Mga GyrA precursor
DRSHAKSARSVAETMGNYHPHGDASIYDTLVRMAQPWSLRYPLVDGQGNFGSPGNDPPAAMRYCTTGDTLVRLPFGQSMRIADVVPGASPNSDNAVELKVLDRHGNPVVADHLFHSGDHQTYTVRTAEGYEVTGTANHPLLCLVDVGGVPTLLWKLIGEIHANDYVALQRTPPMELGPADWHGTMEALLLGAFISEGYVSETRTGFANLDRDYFTTAAGAYDGVVGGKRYVYQQTIGSGSPQHTLYTQKVTALKQSRLWQMVGVRSADKYVPEWMWHSPAAVKRTFLRALFEGGGSCSRLPRKTIQISYTTISKQLAMDVQQMLLEFGVISRRYLHAVGEYKVVITNRAQAELFATQIGFGGAKQTKLTKILASMPPCAGRDSDHVPGLALFIRRHCGSRWVDKEWLHKHNIDRLSRWRRDGAEILSHIADPDVRTIATELTDGRFYYARVASVTDAGVQPVYSLRVDTDDHAFLTNGFVSHNTEARLTPLAMEIVREIDEETVDFIPNYDGRVQEPTVLPSRFPNLLANGSGGIAVGMATNIPPHNKGE

SEQ ID NO: 482 - protein, 419 aa, Mycobacterium gastri
  Mga RecA precursor
RDKIGVMFGCGSWYTNVTLADGSTEKLGKIVNQKMDVEVLSYDFESGQIVPRRVTNWFNNGKAEEFLHFKVDRAGSGTGRGHASLAMTRNHLIRTPVGWREAEDINVGDRVMLAQPRLLSDQQWEIVLGSLMGDGCLSPPVRQDSESARLRIGHGAQQSAYFDWKVSLLANIPHSRTVNGKGAAFVDFSPLAELHELRSAVYLGDGKKFLSEEYLKGLTPLSLAIWYMDDGSFSLRSKGLQQRTQGGSGRIEICVEAMSEGSQVRLRDYLHDTHGLDVRLRKAGAAAKAVLVFSTAATAKFQQLVAPYMAPCMAYKLLPRFHGRSMVTPQFVEPIMELMPARVTEIESKTDYPIMSRFDIEVEGSHNYFADGVMVHNSPETTTGGKALKFYASVRMDVQRIETLKDGTNTVDNRTRVKI

SEQ ID NO: 483 - protein, 534 aa, Mycobacterium gastri
  Mga SufB (Mga Pps1) precursor
AEKQRLVAGVAAQYECLAGDTLVWTANRGQVPIKEIEFGDRVFSYDESAERFVVAPVKASAQTDTRLTYEVKTTRRSVRATDNHPMLVLRDERKEGRQRARYARRWVTVGQIKPGDFIAVPRAVPNFGVAEQLPSVAGLTTPATSSADLMWLLGLYVGDGNLHLSTKTYRVQFAIPATDRELRAELTRVIKDLFGLRCIEADEYRVVVNSKALTEWIAALGFGGLSLTKRVPDWVYGLPVDQRLAFLGGWVDADGYVSPDKSGSILLTCANQALIGQARELAELAGLRAGGPWSFTQPYRHAPDRMQIAWRLGISGDFERLGCRNPKRTDRFGRRRYMHSSSGAHGTTIRAHCNDWLGFERVKAVEPYAVEPVYDIEVDGPHNFVAEGLVVHNSEVVYHQIREDLEAQGVIFLDTDTGLREHPDVFKQYFGTVIPAGDNKFSALNTAVWSGGSFIYVPPGVHVDIPLQAYFRINAENMGQFERTLIIVGENAYVTYVEGCTAPIYKSDALHSAVVEIIVKPGGRCRYTTIQNWS

SEQ ID NO: 484 - protein, 1286 aa, Methanospirillum hungateii JF-1
  Mhu Pol-II precursor
MADISPRMQEYYDRLNAGLAQAMEVAKTARKTGLDPETVVEIPIANDLADRVEAQVGIPGVAQMIRELEAVMSREEASLHIGDYFAEKKFGETTKEEILDHAIRTAMALLTEGVVSAPIEGIAKVAVKKNDDGSEYLAIYYAGPIRSAGGTAQALSVLVGDYVRRILGMSRYMPREEEIERYIEEIRQYNSIMSLQYLPSEREIRLIISNCPVCIDGEPTEKEEVSGHRNLERVETNTVRGGMALVIAEGLALKAPKVLKNVRKMKMDGWDWLEEMIQATAGSSSSEEKEVGIHPKDKFLRDLIGGRPVFSYPMREGGFRLVYGRSRNTGLAAAGLNPATLHILGDFLAVGTQMKIERPGKAAGISPVDSIQGPTVRLINGDVVRIHDAKRARELSSQVSHIIDVGEILISYGEFMENNHVLVPSAYCESWWRLEGGTTRPADEDEAILQCESGLYLHPDYLYLWDDLKPAEIRSLAEFIHKHGTLADKTLILPLDPTIKEYLERVLCEHQVREGMIRITPCRIVLKCLGLDSSLALSDSWEKELPESALDLVQFLSGMKMRSKAGTRIGGRMGRPGKSKPREMKPAPHVLFPVGEAGGSRRSVQEASKFSYQANTEGGNLQLEMGVRRCPACGTESYKNRCSCGTHTEPVLSCSRCGIEVQGPVCPQCGMEPTSVRQYTVNVRQMLQQAFADLGMRDRDVELVKGVKGLVSRNKPVELIEKGVIRAANKLFVFKDGTVRFDIIDMPLTHFRPREIGVSVERLRELGYLQDIYGVPLQNPDQVLELPPQDILVPEGCGDYLFSCTRFIDTLLEKVYGLPPFYNLETRSDLVGHLVIGLAPHTSAGVLARIIGFSKANVGYGHPFFHAAKRRNCFHGDTLIEIYADGILEEIPIRRFVLEHLDLSQAGVDALGTFYADPVRPAHVRSVDTGGIPHLRKITSVSVHKAPANLIQFSTSRGKNLLVTPDHAMLVWDVSYLRKIRALEVKIGDAVPVWESGVVISDRIVSIDYVPCEDERVYCLTVDRDHNVVGNGIFTGQCDGDEDCVMLLLDGLINFSRSFLPVTRGGSMDAPLVLTSRIDPTEIDKESHNLDVCATYPIEVYETALRYGNAKDVESLVDRVERRLNTPAQIEGFFFTHDTSDISAGPLETMYTQLQSMLDKLDCELSLAKRIRAVDEHDVAERVLKTHFIRDLQGNLSAFSKQKFRCTKCNTSYRRMPLAGKCKCGGNIIPTVHEGSVKKYLQMSRQICEEYNITEYTRQRIEVIDMNIESTFGEEKVEQMGLADFM

SEQ ID NO: 485 - protein, 1102 aa, Methanococcus jannaschii (Methanocaldococcus jannaschii DSM 2661)
  Mja GF-6P precursor
MKFMCGIIGYIGNDKAPKILLNGLRRLEYRGYDSCGIGVVDNNKLIIKKNVGKVEEVAKKERFLDIDGNIGIGHCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNSRWATHGNVCKENAHPHTDCKEEIAVVHNGIISNYKELKDELMKKGHKFKSETDTEVVPHLIEEELKKFKEINEENYIKAVKNAIKKLKGTYALVIINKNFPNLLIGARNESPLILGINDDGYFLGSDITAFLDYTNKAIPLEDGDVVVIKKKENGYEVTIENNGNTVEREMMEINWDISSAEKMGYPHFMLKEIMEQPEVLKVSAKISAEEIKELAKCIKDYDRVYFVAMGTSLHAAMVVEYLFAKLGKLVIACDASEFLNKGVVDDKTLVIGITQSGETYDTLKALRFAKKNKAKTGAIVNVLGSTATREADITVMMGAGIEIAVCATKTYTSQLMILYRLFIEYGKLLGRDMSEYEKEIDKIPNYIKEVLDKKETIKEIANNLKVNNYIFISKGINIASALEGALKFKEITYLHAEGMSGGLLKHGTISLIDENMDTVAIVPPRDSAVFNSILSNIEEVKARGGKVIAITPTEIDGAENILVPEVIEEISPIVYAPAFQLLAYYKAVELGRDVDKPRGLAKSVTVE

SEQ ID NO: 486 - protein, 1195 aa, Methanococcus jannaschii (Methanocaldococcus jannaschii DSM 2661)
  Mja Helicase precursor
MDKILEILKDFGIVELRPPQKKALERGLLDKNKNFLISIPTASGKTLIGEMALINHLLDGNKNPTNKKGIFIVPLKALASEKYEEFKSKYERYGLRIALSIGDYDEDEDLSKYHLIITTAEKLDSLWRHKIDWINDVSVVVVDEIHLINDETRGGTLEILLTKLKEFNVQIIGLSATIGNPDELAEWLNAELIVDDWRPVELKKGIYKNEAIEFINGEIREIKAVDNNDIYNLVVDCVKEGGCCLVFCNTKRNAVNEAKKLNLKKFLTEEEKIRLKEIAEEILSILEPPTEMCKTLAECILNGSAFHHAGLTYQHRKIVEDAFRKRLIKVICCTPTLCLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHNSAGLNLPCRRAIVKDLTRFTNKGMRYIPIMEIQQCIGRAGRPGLDPYGEGIIVAKNDRDYLRAYQALTQKPEPIYSKLSNQAVLRTQLLGLIATGEIRDEYDLEWFIRNTFYAHQYGNLREVAKNINEVIRFLEENEFIIDFMPTELGKRVSELYIDPLSAKFIIDGLEEMENEEEIYYLYLISKTLEMMPNLRVYNSEELNLIDEMDSLGIKSFEIEDLEAFKTAKMLYDWINEVPEDEILKRYKIEPGILRYKVENAVWIMHALKEIAKLIGKSSDIPEKLEIRLEYGAKEDIIELLSIKYIGRVRARKLYNAGIRSIEDIINNPSKVASIIGEKIAKKILDELGVKFGQQKLSF

SEQ ID NO: 487 - protein, 785 aa, Methanococcus jannaschii (Methanocaldococcus jannaschii DSM 2661)
  Mja Hyp-1 precursor
MIANVDLHIHSRFSGGTSKDMNVENILKYGKLKGLNIIGTGDCTHPDYLEEIKQYKDRELILTTEIEDKNRVHHLILLPSISKVEELREILKKYSKDIDKEGRPRVSIGGAELLEIVRDVGGLIGPAHCVPPDTLLILENGFKRIVDIKVGDKVLTHENRFKKVEKVYKRRYIGDIIKIKVRYFPEEIILTPEHPVYAIKTEKRCDGSHGICKFNCLTQYTNPSCKKRYRKYKREWIIAKDLKVGDVIVYPIPNRVRDIKYLSLDKYLSNIKREFCRSRIPEKIEVSEEFCRLVGYFLSEGYCFRDGIGFALGENEKKIIDDIEYLMKKIFNLKPKIRDDGRSEGIELKYYSRVLRDFFGDMFYCGDEKRAWNKALPNEFLYLPKNKQLQIFIGWWRGDKGVTTSEILMNQLRLISLRLGFIITFSKHVPKNPKIGDREVIKYHARWQGRVSILDEKIVDELKNEDIKLPKKDVRYGWIKGNYLYAPIIRIGREYYDGFVYNLEVEDDSSYVTVSGTLHNCFTPWTSLYKSFDSIYDCYNKKPDFVELGLSADTDMADMIPELRDLPFLSNSDAHSYHPHRLGREFNQIEVDYIGGIEDNFEQIKKAIKHNKIIANYGLDPKLGKYHLTACSKCHTRFKLEDAKKYNWKCPKCGGSIKKGVLSRVEELSDGKIEHPKFRPPYYKLIPLAEMISLTIGKGIFTKAVQSLWEEFIKKYGNEIEVLINADIDELSKIHPKVAETINLFRKGKIYIYPGGGGEYGKISFKPQKVEWYREEVTLDRWLKQ

SEQ ID NO: 488 - protein, 1155 aa, Methanococcus jannaschii (Methanocaldococcus jannaschii DSM 2661)
  Mja IF2 precursor
MAKKNTKKDNKNQNLRCPIVCVLGHVDHGKCLMPHEKVLTEYGEIKIEDLFKIGKEIVEKDELKEIRKLNIKVHTLNENGEIKIINAPYVWKLKHKGKMIKVKLKNWHSITTTPEHPFLTNNGWIKAENIKKGMYVAIPRKIYGNEDFEKFIEFINSKILTNELIVKVNEKDLKNVELPSTKIYKKQKNVFRSEDIIEHNLNIEKISFSPRIHRCGKPQHYIKLPKSLNEWKAIFYFAGVMFGDGCVDRIANNDEEVFNKLKSLNNLGIEVERIKRKSSYEIIFKNGKNALINLLKILFDYPSEKKSHNIKIPQILYIAPKELVAEFIKGYFDADGYVNLRQNRIEVISASKEFIEGLSILLLRFEITSKIYEIKKSYKETKKKYYQLNIVGKRNLKNFKNIGFSIKYKEENLNKIIEKSRKSEKYPINKDMKRLRILFGMTRNEVNVSYYAKYENGKEIPSYEIVKKFLNSLKPKNLDKKIKVLEGKERDVNYLKAFESDGLIENGRLTKLGREALNIWKNHEFGKENIDYMKSLIENIAFVEVEDVEIIDYDGYVYDLTTETHNFIANGIVVHNTTLLDKIRKTRVAKREAGGITQHIGASEIPIDVIKRLCGDLLKMLKADLKIPGLLVIDTPGHEAFTSLRKRGGALADIAILVVDINEGFKPQTVEAVNILRQCKTPFVVAANKIDLIPGWNSKEGPFILNFNEKNQHPNALTEFEIRLYENIIKPLNELGFDADLYSRVQDVTKTVCIIPVSAVTGEGIPDLLMMVAGLAQKFLEDRLKLNVEGYAKGTILEVKEEKGLGTTIDAIIYDGIAKRGDYLVVGLPDDVLVTRVKALLKPKPLDEMRDPRDKFKPVNEVTAAAGVKIAAPELDKVIAGCPIRIVPKDKIEEAKEEVMKEVEEAKIEVDDEGILIKADTLGSLEALANELRKAGVKIKKAEVGDVTKKDVIEVASYKQSNPLHGAIVAFNVKILPEAQKEIEKYDIKVFLDNIIYKLVEDFTEWIKKEEERIKYGEFEKLIKPAIIRILPDCIFRQKDPAICGVEVLCGTLRVGAPLMREDGMQLGYVREIKDRGENVKEAKAGKAVSIAIDGRVVLKRHVDEGDYMYVAVPESHVRELYHKYMDRLRNDEKEALLRYMELMQKLTNNIFWGR

SEQ ID NO: 489 - protein, 721 aa, Methanococcus jannaschii (Methanocaldococcus jannaschii DSM 2661)
  Mja Klba precursor
MIIKNQLIFVNFYVILIIWWFVMGILDKIQKKSEKIEKEKKSETVIPSDTKLKPIEPHPTINKKATVGNDETILDTYSIKIDEIEMEVVIKREEGYIYYLVPEIDKINMSLSKLTKDHLNHIKSQISDLGLIEYDQIREYLTNFSMRYNLAIPYIDSLAKFFYLVIGRLGLLEVPLNDDRLEEVMVNGYNVPVFVFHRKHQMCETNIVLDRNEVDRIIESIANLVNRPIDSRVPMLDAFLPDGSRVNATTADITMNGATLTIRKFSKNPLTVIDLINFGTLDIDTAAFLWQAVEGYFGAKPANTLIAGGTGSGKTTLLNVLSLFSMYNERIITIEDTPELQIPHKHVIKMVTRPARPGMPEYEVTMDDLIKNALRMRPDRIFVGEVRGKEAHSLLVAMNTGHDGALAYDEPIYLSDGNIINIGEFVDKFFKKYKNSIKKEDNGFGWIDIGNENIYIKSFNKLSLIIEDKRILRVWRKKYSGKLIKITTKNRREITLTHDHPVYISKTGEVLEINAEMVKVGDYIYIPKNNTINLDEVIKVETVDYNGHIYDLTVEDNHTYIAGKNEGFAVSNCSGTLHANSADEAILRLTSPPMNVPKIMLTALNFIINQQRIRRAGKTIRRILGIVEIVKGGGEGHEFAKTTLYEYNGLKDSLERRGICMWEEEVCEIAGITKEELLRDRENRKKVLSYLYKNNIRKLENVSDYIMRYQVDPEKLLRSIR

SEQ ID NO: 490 - protein, 1188 aa, Methanococcus jannaschii (Methanocaldococcus jannaschii DSM 2661)
  Mja PEP precursor
MLIIQNTKGDSMKFIAWLDELSNKDVDIAGGKGASLGEMWNAGLPVPPAFVVTADAYRHFIKETGLMDKIREILSGLDVNDTDALTNASKKIRKLIEEAEMPEDLRLAIIEAYNKLCEMCGEDEVTVAVRSSATAEDLPEASFAGQQDTYLNIKGAENVVKYVQKCFSSLFTPRAIFYREQQGFDHFKVALAAVVQKLVNAEKAGVMFTVNPISENYDELVIEAAWGLGEGVVSGSVSPDTYIVNKKTLEIVDKHIARKETMFVKDEKGETKVVEVPDDMKEKQVLSDDEIKELAKIGLNIEKHYGKPMDVEWAYEKGKFYMLQARPITTLKKGKKEKKAKEEDIEAKILLKGIGASPGIATGVVKIIHDVSEIDKVKEGDILVTEMTTPDMVPAMKKAAAIVTDEGGLTCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNCHAAIVSRELGTPCVVGTKKATKVLKDGMIVTVDGEKGIVYEGEIKKVEEKEKKQEVVVQQAPIITATEVKVNVSMPEVAERAAATGADGVGLLRAEHMILGLGKHPRKILEEEGEEALIEALMEGIRKVADAFYPRPVTYRTLDAPTDEFRGLEGGENEPIEHNPMLGWRGIRRDLDEVDILKCELKAIKRLREEGYKNIEIMIPLVTHPDEVRRVKEIMREVGLEPCKDIPFGIMVETPAAALIIEDFIKEGINFVSLGTNDLTQYTIAIDRNNELVSKYYKEDHPAVLKLVEHVIKTCKKHGIKTSICGQAGSRPHIVEKLVEWGIDSVSANIDAVETIRRVVARTEQKVILNYIRKSYVERE

SEQ ID NO: 491 - protein, 1634 aa, Methanococcus jannaschii (Methanocaldococcus jannaschii DSM 2661)
  Mja Pol-1 precursor
MGMSMGKIKIDALIDNTYKTIEDKAVIYLYLINSILKDRDFKPYFYVELHKEKVENEDIEKIKEFLLKNDLLKFVENIEVVKKIILRKEKEVIKIIATHPQKVPKLRKIKECEIVKEIYEHDIPFAKRYLIDNEIIPMTYWDFENKKPVSIEIPKLKSVAFDMEVYNRDTEPNPERDPILMASFWDENGGKVITYKEFNHPNIEVVKNEKELIKKIIETLKEYDVIYTYNGDNFDFPYLKARAKIYGIDINLGKDGEELKIKRGGMEYRSYIPGRVHIDLYPISRRLLKLTKYTLEDVVYNLFGIEKLKIPHTKIVDYWANNDKTLIEYSLQDAKYTYKIGKYFFPLEVMFSRIVNQTPFEITRMSSGQMVEYLLMKRAFKENMIVPNKPDEEEYRRRVLTTYEGGYVKEPEKGMFEDIISMDFRCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNSLYPSIIISYNISPDTLDCECCKDVSEKILGHWFCKKKEGLIPKTLRNLIERRINIKRRMKKMAEIGEINEEYNLLDYEQKSLKILANSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNSVYGYLAFPRARFYSRECAEIVTYLGRKYILETVKEAEKFGFKVLYIDTDGFYAIWKEKISKEELIKKAMEFVEYINSKLPGTMELEFEGYFKRGIFVTKKRYALIDENGRVTVKGLEFVRRDWSNIAKITQRRVLEALLVEGSIEKAKKIIQDVIKDLREKKIKKEDLIIYTQLTKDPKEYKTTAPHVEIAKKLMREGKRIKVGDIIGYIIVKGTKSISERAKLPEEVDIDDIDVNYYIDNQILPPVLRIMEAVGVSKNELKKEGAQLTLDKFFK

SEQ ID NO: 492 - protein, 1634 aa, Methanococcus jannaschii (Methanocaldococcus jannaschii DSM 2661)
  Mja Pol-2 precursor
MGMSMGKIKIDALIDNTYKTIEDKAVIYLYLINSILKDRDFKPYFYVELHKEKVENEDIEKIKEFLLKNDLLKFVENIEVVKKIILRKEKEVIKIIATHPQKVPKLRKIKECEIVKEIYEHDIPFAKRYLIDNEIIPMTYWDFENKKPVSIEIPKLKSVAFDMEVYNRDTEPNPERDPILMASFWDENGGKVITYKEFNHPNIEVVKNEKELIKKIIETLKEYDVIYTYNGDNFDFPYLKARAKIYGIDINLGKDGEELKIKRGGMEYRSYIPGRVHIDLYPISRRLLKLTKYTLEDVVYNLFGIEKLKIPHTKIVDYWANNDKTLIEYSLQDAKYTYKIGKYFFPLEVMFSRIVNQTPFEITRMSSGQMVEYLLMKRAFKANMIVPNKPDEEEYRRRVLTTYEGGYVKEPEKGMFEDIISMDFRCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNSLYPSIIISYNISPDTLDCECCKDVSEKILGHWFCKKKEGLIPKTLRNLIERRINIKRRMKKMAEIGEINEEYNLLDYEQKSLKILANSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNSVYGYLAFPRARFYSRECAEIVTYLGRKYILETVKEAEKFGFKVLYIDTDGFYAIWKEKISKEELIKKAMEFVEYINSKLPGTMELEFEGYFKRGIFVTKKRYALIDENGRVTVKGLEFVRRDWSNIAKITQRRVLEALLVEGSIEKAKKIIQDVIKDLREKKIKKEDLIIYTQLTKDPKEYKTTAPHVEIAKKLMREGKRIKVGDIIGYIIVKGTKSISERAKLPEEVDIDDIDVNYYIDNQILPPVLRIMEAVGVSKNELKKEGAQLTLDKFFK

SEQ ID NO: 493 - protein, 1613 aa, Methanococcus jannaschii (Methanocaldococcus jannaschii DSM 2661)
  Mja r-Gyr precursor
MIPMIYKEMCPNCNGEITSERLAIGVCEKCLKEENVFEKLKLCEKLREEKTLKNLKDYCIIWNEFKEFEEFVKDLGFELLSIQKMWAKRVLKNKSFSIVVPTGVGKSFFGILMSLFLAKKGKRCYIILPTTLLVKQTYEKISSLTEKNNLNIRVVAYHSELSTKEKKEVKERIENNDYDVLITTSNYLTKNMPKCKFDFVFVDDVDALLKASKNIDRTLKLLGFDEEIINEAYKIIYLIKIGKIEDAMKKREILKKKISKIKHGCLIIASATGKSYGDRVKLYRELLDFEIGFGMNKLRDVVDIYDEEFSKEKILEYIKLFGSGGIVFVSIDYGVEKAQEIEKYLLENNIKAKLIHSKDKKGFDDFREGKIDVLIGVASYYGVLVRGLDMPERVRYAIFYGIPKFKIRLKEYINSLKEKGELKEDINIEGKTEEEIRQIITEKLKIKNFSLRKEDDEYLLLIPDVKTYIQASGRTSRMTEFGLTKGASIVLVDEKEIFEALKKYMLFMYESEFKRIDEVNLEELIKKIDEDREKIKVGRAKGKVPDLLKSVLMVVESPNKARTIANFFGKPSVRKINNRNVYEVCIGDLNLIITASGGHVFDLVTKEGFYGVKIENNLYIPIYTSIKKVNGEQFTDQKDLEELIKQLMEKGERVNAMDAKENIEIIREIADEVDAIFIATDIDTEGEKIGYDIAINALPFNRNIYRVGFNEITKRAILKAVESFKKGEELSLDENKVKGQVVRRIEDRWIGFRLSQKLWEVFNKNYLSAGRVQTPVLGWIIERYNEHKIKVPYLSLKLENDIYIGKIWEDEFDKDEVEVEVKVYEKEIPPLPPFTTDTLLEEATKRFGLSTDEIMSIAQELFELGLCLTPDTYVVLGDGRIETIEDIVNAKERNVLSLDLDNLSIKIDTAIKFWKLRYNGNLSKITLSNNYELKATPDHCLLVLRDNQLKWIPAKDIKENDYIAMPFNYKVERKPISLLNLLKYLDITDVLIEFDENSTIFEKIAEYIRNNIKTSTKYKYLRNRRVPLKYLIEWNFDLDEIEKEAKYIYKSVAGTKKIPLFKLDERFWYFAGLVLGDGSIQDSKIRIAQTPLKDVKSILDETFPFLHNWISGNQVIISNPIIAEILEKLGMRNGKLNGIIFSLPESYINALIAGYFDTDGCFSLLYDKKAKKHNLRMVLTSKRRDVLEKIGIYLNSIGILNTLHKSREVYSLIISNKSLETFKEKIAKYLKIRKEAFINGYKTYKKEHEERFECDLLPVKEVFKKLTFEKGRKEILKDSKIHIENWYKEKTNNIPREKLKTVLRYANNSEHKEFLEKIVNGDISFVRVKKVENIPYDGYVYDLSIKHNQNFISNGVISHNCTYHRTSSTRVSLDGMRVAREYLKLNNLEDYLKNREYFMEGAHECIRPTKPMNTDELIEFLKENNIKLTKNHIKVYDLIFRRFIASQMKEAVVEYEEIYIKDLDEKVEGYVDIKFDGWSRIYNLKLKKLPRIEKSSLKVLDKKLRKIPKVPLYDEGEVVKLMKERGIGRPSTYAQIIKKLLDRGYVVKSKDKNKLIPTKLGIEVYNYLINNYPHLISEERTRELEEIMDKIENGEVDYIEVLKALHEEILSIR

SEQ ID NO: 494 - protein, 1847 aa, Methanococcus jannaschii (Methanocaldococcus jannaschii DSM 2661)
  Mja RFC-1 precursor
MVIIMEKPWVEKYRPKTLDDIVGQDEIVKRLKKYVEKKSMPHLLFSGPPGVGKCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNTTAALCLARDLFGENWRDNFLELNASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSDERGIDVIRTKVKDFARTKPIGDVPFKIIFLDESDALTADAQNALRRTMEKYSDVCRFILSCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNCNYPSKIIPPIQSRCAVFRFSPLKKEDIAKKLKEIAEKEGLNLTESGLEAIIYVSEGDMRKAINVLQTAAALSDVIDDEIVYKVSSRARPEEVKKMMELALDGKFMEARDLLYKLMVEWGMSGEDILNQMFREINSLDIDERKKVELADAIGETDFRIVEGANERIQLSALLAKMALMGR

SEQ ID NO: 495 - protein, 1847 aa, Methanococcus jannaschii (Methanocaldococcus jannaschii DSM 2661); identical to SEQ ID NO: 494
  Mja RFC-2 precursor

SEQ ID NO: 496 - protein, 1847 aa, Methanococcus jannaschii (Methanocaldococcus jannaschii DSM 2661); identical to SEQ ID NO: 494
  Mja RFC-3 precursor

SEQ ID NO: 497 - protein, 1750 aa, Methanococcus jannaschii (Methanocaldococcus jannaschii DSM 2661)
  Mja RNR-1 precursor
MISAKDFAEKVMEFYVIKRDKRKEKFNVNKLAKSLINSGVNYGDLDTIISEVCAKVYNGITTDELKDIVYNVLKKIDKDVAENYRNGIILKVRTSEKEFESFDKEKIAKALIRETGADEETARKIADEVERELKKLKVKYLTAPMIREIVNYKLIEYGFEELRHKHTRLGMPVYDITKLIKSGSRENANLMYNPESIHKWVADETMKQYALLAIFPKHIADAHIKGDIHLHDLEYAATRPVCLQHDLRPFFKYGLKVDGTGLHTSVSKPAKHPEVAIQHAAKVMMAAQTNMSGGQSIDEFNVWLAPYVRGLSYEKIKQLMQMFIYELNQMYVARGGQSLGRDELIFIKEGDKLKVCKIGEAIDEFMEKYKDKIIVDGDTEILYLDGIAEVYTISVNVKTGKAEFKRVYAISRHKPRGKVYKVIGKDGTSIIVTEDHSLFNYDENGNLVCVKPRQMKHIIRNFNNPYDVEYRIGDYIETNYQRTDSKYNSRQNDIPEKLKITKELCQFLGLFVAEGSYITNGISITTKDDDIAKFIERFVKEQINENIAVKRYEDSVRFVNKGFYRFLKEHINGKAINKNSPEFILKGDKEMKLAFLGGLISGDGYVSKDGRVQIYTTSEQLLGQLHLLLSDLGMIYSITKIKEEGEKIEIKRNEIVRNYKLYVIEIAKNCTEDLKPYVIPKYKKERIKPANYDQLPYDYRIIKEHLRKITDKKPYNDYAWKSNNRKLKLNTLEKIEQLNPHLREEINKFKLNIPFEIKEIKEIDYNGYVYDLSVEDNENFITATGILCHNTIFSSINLELEIPEFLKDKPAVIAGTTRGTYGDYEEEAKLILEALVDVMMEGDAMGKPFLFPNFIIKLRENAFKDENKELMYKIHQLSAKFGIPYFINMLPDWQVTNTNAMGCRTRLSGNWTGDAEIDTLRTGNMQWYSLNLPRIAYEANGDDTKLFEILHERLEILKEALLIKHEVTKERLYVDNLMPFLTQEFDGESYYRYENTTKTFGFVGLNEMLKYHLGEELHESKDAVKFGEKVIEYIREYADKLKEETGLRWTVTQTPAESSLPYDEKILIFENNEYKLVKIGEFVEKYLNRYKDRAITYGDNNIEVYIKDENIYAPSFDKDGKIVLKPITHAIRHRGKEIYEIELESGKKVRVTGDHSVFTINDNLDVVEVKASDLKVGDFIITPKIIPSISKDKIYLSEIVKNKDKYYVKIKDHIKFIEEHEEILKESYKEYKTKWKDLKPVLKKKNAFRLDLIEDLVDKEKIEKISYGHANYINNKIKLDEKFGYLIGAFLSEGHWNDKCVEISSTNKEFIENLVEIIEEILGKDAYYITVKGDKRRYKDLYVIGLNKTVAMIFESLGLNKLSSNKEIPSILLSNETFLKGLIKGYIDGDGSIYVDESKRDYSIRLYTTSETLRDTLCLALKILGINYRLSIDKKSKVNENWRDCYVIKITGKENIEKLLDVEIKNNGGKDVIPKIAEKFKEIINQYSQREWKERFGIDVNNLHIWEDLKKGYMSRYRAKKVLNIMKNVKEIEEKYGRLLDKIGQLIDNDLLFERIKSIRVLDEIPEYVYDISVEGTENFIGGEGFICLHNTAGRFARLDYKYYKEETISVVRGDLNDVDSLYYTNSSHVRVDAPITLGEKVRIEEKFHPLCNGGHIMHIWNIESAADPEVLMDITKKITKTHIGFWTYTKNLSVCNRCGISMGGLRDRCINCGSEDVAKFSRITGYLQNISNWNRAKQKELEDRKLPRI

SEQ ID NO: 498 - protein, 1750 aa, Methanococcus jannaschii (Methanocaldococcus jannaschii DSM 2661); identical to SEQ ID NO: 497
  Mja RNR-2 precursor

SEQ ID NO: 499 - protein, 1345 aa, Methanococcus jannaschii (Methanocaldococcus jannaschii DSM 2661)
  Mja rPol A' precursor
MVILMERYEIPKEIGEIMFGLLSPDYIRQMSVAKIVTPDTYDEDGYPIDGGLMDTRLGVIDPGLVCKTCGGRIGECPGHFGHIELAKPVIHIGFAKTIYKILKAVCPHCGRVAISETKRKEILEKMEKLERDGGNKWEVCEEVYKEASKVTICPHCGEIKYDIKFEKPTTYYRIDGNEEKTLTPSDVREILEKIPDEDCILLGLNPEVARPEWMVLTVLPVPPVTVRPSITLETGERSEDDLTHKLVDIIRINNRLEENIEGGAPNLIIEDLWNLLQYHVNTYFDNEAPGIPPAKHRSGRPLKTLAQRLKGKEGRFRYNLAGKRVNFSSRTVISPDPCLSINEVGVPEVVAKELTVPEKVTKYNIERIRQLLRNGSEKHPGVNYVIRKMIGRDGTEQEYKVKITESNKDFWAENIREGDIVERHLMDGDIVLYNRQPSLHRMSIMAHRVRVLPYRTFRHNLCVCVDGDTTVLLDGKLIKIKDLEDKWKDVKVLTSDDLNPKLTSLSKYWKLNADEYGKKIYKIKTELGREIIATEDHPFYTTNGRKRCGELKVGDEVIIYPNDFPMFEDDNRVIVDEEKIKKVINNIGGTYKNKIINELKDRKLIPLTYNDQKASILARIVGHVMGDGSLIINNKNSRVVFRGDIEDLKTIKEDLKELGYDGEEIKLHEGETEITDYNGKKRIIKGKGYSFEVRKKSLCILLKALGCVGGDKTKKMYGIPNWIKTAPKYIKKEFLSAYFGSELTTPKIRNHGTSFKELSFKIAKIEEIFDEDRFIKDIKEMLKEFGIELKVRVEEGNLRKDGYKTKVYVASIYNHKEFFGRIGYTYANKKETLARYAYEYLLTKEKYLKDRNIKKLENNTKFITFDKFIKEKCLKNGFVKEKIVSIEETKVDYVYDITTISETHNFIANGFLTGNCPPYNADFDGDEMNLHVPQSEEARAEAEALMLVEKHILSPRFGGPIIGAIHDFISGAYLLTSNYFTKDEATLILRSGGIKDELWEPDKVENGVPLYSGKKIFSKALPKGLNLRYKAKICRKCDVCKKEECEYDAYVVIKDGELIKGVIDKNGYGAEAGLILHTIVKEFGPEAGRKFLDSATKMAIRAVMLRGFTTGIDDEDLPEEALKEIEKVLDEAEEKVKEIIEKYERGELELLPGLNLEESREAYISNVLREARDKAGAIAERYLGLDNHAVIMAVTGARGNILNLTQMAACLGQQSVRGKRIFRGYRGRVLPHFEKGDLGARSHGFVRSSYKKGLSPTEFFFHAMGGREGLVDQAVRTAQSGYMQRRLINALQDLKTEFDGTVRDSRGIMIQFKYGEDGIDPMLADRGKAVNIDRIIDKVKMKYNQ

SEQ ID NO: 500 - protein, 968 aa, Methanococcus jannaschii (Methanocaldococcus jannaschii DSM 2661)
  Mja RtcB (Mja Hyp-2) precursor
MKDVLKRVSDVVWELPKDYKDCMRVPGRIYLNEILLDELEPEVLEQIANVACLPGIYKYSIAMPDVHYGYGFAIGGVAAFDQREGVISPGGVGFDINCLTSNSKILTDDGYYIKLEKLKEKLDLHIKIYNTEEGEKSSNILFVSERYADEKIIRIKTESGRVLEGSKDHPVLTLNGYVPMGMLKEGDDVIVYPYEGVEYEEPSDEIILDEDDFAEYDKQIIKYLKDRGLLPLRMDNKNIGIIARLLGFAFGDGSIVKENGDRERLYVAFYGKRETLIKIREDLEKLGIKASRIYSRKREVEIRNAYGDEYTSLCEDNSIKITSKAFALFMHKLGMPIGKKTEQIYKIPEWIKKAPKWVKRNFLAGLFGADGSRAVFKNYTPLPINLTMSKSEELKENILEFLNEIKLLLAEFDIESMIYEIKSLDGRVSYRLAIVGEESIKNFLGRINYEYSGEKKVIGLLAYEYLRRKDIAKEIRKKCIKRAKELYKKGVTVSEMLKMDEFRNEFISKRLIERAVYENLDEDDVRISTKFPKFEEFIEKYGVIGGFVIDKIKEIEEISYDSKLYDVGIVSKEHNFIANSIVVHNCGVRLIRTNLTKEEVQSKIKELIKTLFKNVPSGLGSKGILKFSKSVMDDVLEEGVRWAVKEGYGWKEDLEFIEEHGCLKDADASYVSDKAKERGRVQLGSLGSGNHFLEVQYVEKVFDEEAAEIYGIEENQVVVLVHTGSRGLGHQICTDYLRIMEKAAKNYGIKLPDRQLACAPFESEEGQSYFKAMCCGANYAWANRQMITHWVRESFEEVFKIHAEDLEMNIVYDVAHNIAKKEEHIIDGRKVKVIVHRKGATRAFPPKHEAIPKEYWSVGQPVIIPGDMGTASYLMRGTEIAMKETFGSTAHGAGRKLSRAKALKLWKGKEIQRRLAEMGIVAMSDSKAVMAEEAPEAYKSVDLVADTCHKAGISLKVARMRPLGVIKG

SEQ ID NO: 501 - protein, 673 aa, Methanococcus jannaschii (Methanocaldococcus jannaschii DSM 2661)
  Mja TFIIB precursor
MVWLMEALKTKENETTKEKKLTTKVEKSEKKEENVREEEIVCPICGSKEVVKDYERAEIVCAKCGCVIKEKLFDIGPEWRAFDHEQKIKRCRVGAPMTYSVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKELPNIEEDIEIDKKFSKILGYIIAEGYYDDKKIVLSYDYNEKEFINETIDYFKSLNSDITIYSKDLNIQIEVKNKKIINLLKKLRVKNKRIPSIIFKSPYEIKKSFIDGIFNGKDAKVFVSKELAEDVIFLLLQIKENATINKKSINDIEVYEVRRITNIYTNRKLEKLINSDFIFLKIKEINKVEPTSGYAYDLTVPNAENFVAGFGGFVLHNTIHDKGLSTVIDWRNKDSYGKDLSANKRAQLYRLRKWQRRIRVSDAAERNLAFALSELDRITSKLGLPRHVRENAAIIYRGAVEKGLIRGRSIEGVVAAAIYAACRRCRVPRTLDEIAEASRVDRKEIGRTYRFLARELNIKLTPTNPIDYVPRFASELGLPGEVESKAIQILQQAAEKGLTSGRGPTGVAAAAIYIASVLLGCRRTQREVAEVAGVTEVTIRNRYKELTEHLDIDVTL

SEQ ID NO: 502 - protein, 895 aa, Methanococcus jannaschii (Methanocaldococcus jannaschii DSM 2661)
  Mja UDP GD precursor
MNISVIGTGYVGLIQAVGLAEFGFDVVGIDIDESKVKALNRGECPLYEEGLEGLLKKHVNKNLTFTTSYKPIKDSDVIFLCVGTPQDKDGNADLRFLFSAVEKIKETIDKEDYKVIVIKSTVPVGTNRRVKELLKDYNVDVVSNPEFLREGIAVYDFFNPERVILGFENLNNKKPIEIMEEVYKYFKDKNIPFVITNWETAELIKYASNAFLATKISFINELAKLSDKVKADIKTISYAMGLDPRIGNKFLNAGIGYGGSCFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHNCFPKDVKALIKQFENNNIEPILIKATDIVNEEQIKWFFEKIKNYYGNLNGKTFAVLGLAFKPNTDDLRESRAIKLIDMLLESGAIVKGFDYVEKARENTINMYKLDKSKGFYGYNLYVLDDLYETVKNVDGIIITVEYDFNKEDWEKIGNLVKEKVVFDGRNILDVEKIKKLGFKYYGVGR

SEQ ID NO: 503 - protein, 1249 aa, Methanopyrus kandleri AV19
  Mka CDC48 precursor
MPGLPIKLRVEKAYPEDVGKRAVRMDKASRDRIGVSEGDLVKITGSKTTVARVLPAKKEDVGKGIVRMDKYERQNAGASVGEPVEVDRAEEKVAKRVELMPTERVVVPVQAGLKEEVEEELTREHEQDILEQIKRYLRSRAQQTPIPATHRDVIPLEVQGKTIAGHVLIKFPDSLLVVGIEPEDATVIGPETEIEVKPYSEDLAKAAEIPDVTYDDIGGLDREIELIREYVELPLKRPELLKELGIKPPKGVLLYGPPGTGKTLLAKAVANECGAKFYSINGPEIMSKYYGESEARIREVFEEARKNAPAIIYIDEIDAIAPKRGETGEVERRVVAQLLTLMDGLSEDERVVVLASTNRPDDIDPALRRPGRFDKEIEIGVPDKEGRKEILQIHTRDMPLADDVDLDKLAELTHGFTGADLEALCKSAGLKALRRAIRKIGAKLAEKGEKEEREVAVKVSELSDEELMEVLEKGLDRARIPEEKKRALRRVLREAEEEEKEEVAYTDALDKVLEAEELPEIREELKVTMRDFMEALKEIEPSALREVIVEVPDVSWDDVGGLEDVKQELKEAVEYPLKYPEVYEKLGTRPPKGILLYGPPGTGKTLLAKAVANESDANFIAVRGPEVLSKWVGESIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNSEKKIREIFQKARQTAPCVIFFDEIDAIAPKRGTEVGGSRVTERIVNQLLTEMDGIEATEDVFVIAATNRPDIIDEALLRPGRFDRIVYVPPPDEEAMKEIVKIHTRDMPLAEDLTVDDIVEILRRREREEDAKYTGADIEAVCMEAAMLALREVLDELERIEKESETEEELEARKEALLEELRVERRHFEKAVEKVPPSVPKEKLEEYEKLKEEYQRLAG

SEQ ID NO: 504 - protein, 635 aa, Methanopyrus kandleri AV19
  Mka RFC precursor
MAEHELRVLEIPWVEKYRPKRLDDIVDQEHVVERLKAYVNRGDMPNLLFAGPPGTGKTTAALCLARELFGEHWRDNFLELNASVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHNSDERGIDVIRTKVKNFARTRPMGGARFKIIFLDEADNLTRDSQQALRRIMEMYSDACRFILAANYSSAIIDPIQSRCVVFKFTKLPESAIKERLRKIAESEGVEITEDALDAIVYVSEGDMRRAINVLQAAAALGREIDEDTVFQIAATARPEEVREMIHHAWNGDFERARELLHELLTRYGMSGEDVVRQVHREIFDMDEIPEEAIPELVNAVGDFEYRLIRGSDERIQLEALLARIHALGNEYSGG

SEQ ID NO: 505 - protein, 988 aa, Methanopyrus kandleri AV19
  Mka RtcB precursor
MAPKSMLKHIRNNVVWELPEDYKGCMKVPGRIYATEKLIDGMEKGVFDQVANVACLPGIYGYSIALPDAHYGYGFPIGGVAAFDVEEGVVSPGGVGYDINCLAPGTKILTEHGCWVKVEDLPKMLTDQKLKVYDVDEGREDDSEIKFVMERGIEEDERAVVLVTESGLTIEGSEDHPVLTPEGYVELGEIEEGDLVVVYPFEGVEYEEKEGTILDESDFEDVDPQVLRYLEERDLIPLRWSDPKVGTLARILGFAMGDGHLGEQAGRLTLSFYGDERTLRELKRDLESLGVKANLHVRKRRYEIETASGRYEGEATSVELRVASRSFALLMEKLGMPRGRKVETPYKVPDWIKEAPLWVKRNFLAGLFAADGSVVKFKRYTPLPINLTQAKVEELEENLREFMNDVAKLLREFGIETTLYEVKSKKNVVYKLAIVGEENIKRFLGKVGYEYDPEKKVEGLAAYAYLKLKERVKKDRKEAAETAAEVYEETGSITKAHEAVADVVNRRFVERVVYDGGISSVRVPEDFPTFERFKEERVLAGGFVIEEVVEVKGVEPEYDRFYDIGVCHGAHNFIADGVVVHNCGVRVMKTDLTEDDVRPKLRELLETIFRNVPAGLGSRHRRVRLSTQELRQVMLYGAEWAVEEGFGFDEDLDHIESRGNMTHAYETIGWEEYGPRDDVASKRAIERGRPQLGTLGSGNHFLEVQVVDEIYDKEAAEKMGIREEGQVTIMVHTGSRGFGHQVCSDHLRIMERSMRDVERRFGVRIPDRQLACAAMGTDEAKRYFNAMNAAANYAFANRQMISHWTRESFVEVFGDEYGDADDMGIEVIYDIAHNMAKIEKHPVDGEERWLVVHRKGATRAFSEEALKKHGEPVPFEGLPQPVLIPGDMGTGSYILIGTEKAMEETWGSTCHGAGRTMSRAAAKRKFWGEDVARELERQGILVKAASMPVVAEEAPPAYKDVDEVVRAVAEAGISDPVVRLRPIGVVKG

SEQ ID NO: 506 - protein, 990 aa, Methanopyrus kandleri AV19
  Mka VatB precursor
MAEAERPAGKEYTTISEVSGPLMVVEGVEGAKYGEVVEVETPTGEVRRGQVLEARRDAAVVQVFEGTSGLDTTSTKVRFTGETLRIPVSTDLLGRILNGRGEPIDGGPEIVPEDELDIHGAPINPAARKYPSDFIQTGISAIDGMNTLVRGQKLPIFSGSGLPHNELAAQIARQATVPGEEEEFAVVFAAMGITHEEAAFFRREFEETGALDRAVLILNLADDPSMERIITPRIALTVAEYLAFENDMHVLVILTDMTNYCFAPGTRVITASGDVVEIDEIVERAAETAVDGGLREGSTEVTVGVTNVRTLAAWDGDLTSNDVVAVEKIEAPSRAVRVRTRSGAELVVSEDHKFLVDTEDGPRMVEASELKSGDELYSVRELRVSEKVPTYLELLLEAEDKFYVHPTEEFEEAVAERYGSLAEACREKELPYRAREAKERRYYELSEFARLATAVIESVDEATEYIDYVTAGGRKRVKFSSPRPGKEVMYVAGLIASDGSVDTERGFVMFSNTERELLSAFEEIVTEEFGVDASKTENQNGVTMLRVNSRVLARVFERLADPKTVLKMPRELVAAYLAGYVDGDGHLKDGKIVITTADRERAGDLQLLLKRLGVPSVLRERDGAYDVVVTGHDAAELAEELPLRHPKKAEAAASMSSGRRSSRFDRVSRRFGRLLREVRRKYGVRASDLGSSSTISQIESGERRATRRLALEIVERLEEVVGDVEEVRELRELAEGNYVLDEVVEVETVEYEHEYLYDVTVVPDHTLVVENGIITSNCEALREISAAREEVPGRRGYPGYMYTDLATIYERAGCIRGRKGSITQMPILTMPHDDITHPIPDLTGYITEGQIVLSRDLHRRGIYPPIDVLPSLSRLMDEGIGKGKTREDHPDLSNQLYAAYAEGRDLRDLVAVVGEEALTERDRKFLKFADEFEQRFVKQGRDENRSIEETLDLGWELLAILPERELKRVSDELIEKYHPKYRQKKEEQEE

SEQ ID NO: 507 - protein, 549 aa, Mycobacterium kansasii
  Mkas GyrA precursor
RPARSHAKSARSVAETMGNYHPHGDASIYDTLVRMAQPWSLRYPLVDGQGNFGSPGNVPPAAMRYCVTGDALVRLPFGQSMRIADVVPGARPNSDNAVELKVLDRHGNPVAADRLFHSGDHQTYMVRTAEGYEVTGTANHPLLCLVDVGGVPTLLWKLIEEIHPDDYVALQRTPPMELGPADWHDTMEALLLGAFISEGCVSETRAGFANLDRDYFTMVARAYDAVVGDKRDVYQQTIASGSLQHTLYTQNVTALKQSRLWQILGMRSADTYVPEWMWHSPAAVKRVFLQALFEGDGSCSRRPHNTIQISYNTVSKQLAMDVQQMLLEFGVISRRYLHAAGEYKVVITDRAQAELFPKQIGFGGAKQTELSKILAAMPPCAGRDSDHVPGLARFIRRHCDSRWVDKEWLHKHNIDHLSRWRRDGAEILSHIADPDVRTIATDLTDGRFYYARVASVTDTGVQPVYSLRVDTDDHAFLTNGFVSHNTEARLTPLAMEMLREIDEETVDFIPNYDGRVQEPTVLPSRFPNLLANGSGGIAVGMATNIPPHN

SEQ ID NO: 508 - protein, 604 aa, Mycobacterium leprae, strain TN
  Mle DnaB precursor
MAVVDDLAHSGMDAVPPSEDFGRQPPQDLAAEQSVLGGMLLSKDAIADVLERLRSGDFYRPAHQNVYDAILDLYGRGEPADAVTVAAELDRRGLLRRIGGAPYLHTLISTVPTAANAGYYAGIVAEKALLRRLVEAGTRVVQYGYAGAEGADVAEVVDRAQAEIYDVAECRLSENYVPLEDLLQPTMDDLDAIASNGGISRGAPTGFTELDEVTNGLHPGQMIIVAARPGVGKALALDTPLPTPTGWTAMGDVAVGDELLAVDEAPTRVVAATEVMLGRPCYEIEFSDGTVIVADAQHQWPTSYGIRTSAQLRCGLDIIAAAGSTPRHAGRLTTAAFMAPVLCIDSVRRVRSVPVRCVEVDNAAHLYLAGRGMVPTHNSTLGLDFMRSCSIKHRLASVIFSLEMSKSEIVMRLLSAEAKIKLADMRSGRMTDDDWTRLARRMSEISEAPLYIDDSPNLTMMEIRAKARRLRQKTNLKLVVVDYLQLMTSGKRFESRQVEVSEFSRHLKLLAKELELPVVAISQLNRSPEQRTDKKPMLSDLRESGSLEQDADVVILLHRPDAFDRDDPRGGEADLILAKHRNGPTKTVTVAHQLHLSRFTNMAR

SEQ ID NO: 509 - protein, 711 aa, Mycobacterium leprae, strain TN
  Mle RecA precursor
MAQVPDREKALELAMAQIEKNYGKGSVMRLGDEMCQPISVIPTGSIALDVALGIGGLPRGRIVEIYGPESSGKTTVALHAVANAQAVGGVAAFIDAEHALEPEYAKKLGVDTDSLLVSQPDTGEQALEIADMLIRSGALDIVVIDSVAALVPRAELEGEMGDSYVGLQARLMSQALRKMTGALSNSGTTAIFINQLREKIGVMFGCMNYSTRVTLADGSTEKIGKIVNNKMDVRVLSYDPVTDRIVPRKVVNWFNNGPAEQFLQFTVEKSGSNGKSQFAATPNHLIRTPGGWTEAGNLIAGDRVLAVEPHMLSDQQFQVVLGSLMGDGNLSPNLCDRNGVRFRLLGYGCKQVEYLQWKKALMGNIRHTVRENSMGASFIDFTPLPELVELQRAVYLGDGKKFLSEEYLKALTPLVLAIWYMDDGSFTVGSKRVQERTAGGSGRIEICVDAMTEGTRVRLRDYLCDTHGLDVRLREVGSAGKAVLVFSTAATAKFQSLIAPYVAPSMEYKLLPQFRGRGSVTPQFVEPTQQLVPARVLDVHVKLSTRSMNRFDIEVEGNHNYFVDGVMVHNSPETTTGGKALKFYASVRMDVRRIETLKDGVDAVGNRTRVKIVKNKVSPPFKQAEFDILYGKGISREGSLIDMGVEQGFVRKSGSWFTYEGEQLGQGKENARNFLLENADVANEIEKKIKEKLGIGAVVTDDDILPTPVDF

SEQ ID NO: 510 - protein, 800 aa, Bacteriophage Aaphi23
  MP-Aaphi23 MupF precursor
MLMNLPEILKSQKKWKARKFRTVKTSKRTELWYRQQLKQFVKTMTDDIERALQQPQGSFFMDDAEGFKAISAKALLAYLEKYEKTDRTSQAENIAQGFVSRGDAQNQAEVSTNLKNQTGVDLAGYLRNSPNIAEKVNALTIDNVQLITNISSQYLDKVKSAVTRAMVSGSLNKDLAAQIKAIGQKTEKRAAFIARDQSSKLNAALTQARHEDLGVKKYMWSTAGDERVRDSHEELDGKVFSYDKPPEVGNPGHDFNCFPGQSELKGLPRPEKLYRRWYSGKLTELVTDNGTVLLATPNHPILTSNGIKSIDSVNVGDYLACEIKQTFDTVKLNGKNLIPTIEQVFNSLLLNGVRTSISSSKSGKFHGDFSDSEIEIISIDSFLIDVLNALFIKKLPELGFTNADMVICKALFSTDSHFDLLKCASGSTGSSFMSRFNLLCSLLVAHLTPLELFCLGLGANIGIIGKQIPANNISRDVEMFSNHIFACAALIHGKDFINWQRDRIMSLVAPNFGHRYTDSFETLSKRLLVTTNNSANFGNAQSLGIEFRRVVNKVVTQASCHIYNLQTVSGYYNINSVFVSNCRCVAIPVFDEAQSKAKAQETLSEPVKENLTLSIDKLVEKSKKIEQTITADINNITIKAGGKLVGLENRLKTAPSIKRKIEAEVADGFSKSLSLNKIGDAIRYTTVFKEGDFVTRYKAMQYLLAIKGYKTIIVKNTWKNDSAYTGVNTFIQNEDGDVFEMQYHTQQSFDLKNGLLHKIYKQFRNPKTPFHEKEKLLLEMRKLSSKIKVPKGIELIEDKK

SEQ ID NO: 511 - protein, 903 aa, Mycobacteriophage Bethlehem
  MP-Be DnaB precursor
MAVHYPESLLPAPSHIQGPTWRQYEDGSWFLPEKTLGWQIISWLFEYVNSPAGDGPFVPTLEQARFIAWWYAVDDQGKYAYREGTLRRMKGWGKDPMIGALALAELCGPVAFSHFDDNGNPVGKTRHAAWVTIAAVSQDQPLALNTEVPTPSGWTTVGDLSVGDYVLGSDGQPHRVQRETPVLEGLATYVVRFDDGTEITASASHGWTTQRLTGHGDSYETVTVTTEELAQTVTNSKGRKRHRIPVVGMELPNQELPLDPWFLGLWLGDGATSDSTVSFDYRLRDEYATLLKPLVQEFQTVVWDNPVPGTNVGTFRIKNNDRTQDDKSIRSLLRKAGVLGNKHIPAAYMQAGTDQRFELLRGLIDSDGGIDSVGRAYFVNANRNLVYQFQELVVGLGFRCTVREHGGDGALRAEFNPGNAVRVSNLAYKFERQRPYSSRNRSQHRWVESVTPVESVPVKCIGIDTEDHLFQVSRSRILTHNTKNTFSLFPIMVSKKLKTEYGLSVNRFIIYSEIGGRLEAATASPASMEGNRPTFVVQNETQWWGVGPGGEVNDGHQMAEVIEGNMTKVDGARTLSICNAHRPGDDTVAEMSYLNWLDILAGDAIDTGVLYDALEAPADTPVSEIPFPSDDPEGYEAGVAQLMKGLEIARGDSIWLPLDDILMSVLTAKNDVIESRRKFLNQVNATEESWIAPSEWDRNHDINLPPLRKGERITLGFDGSLSNDHTALTACRVEDGALFLVKVWVPEKYEGHKVPRQDVDAYVRSMFEKYDVVGMRADVKEFEQSVDAWGQDFRRKLKINASPGNPVAFDMRGQQKRFALDCERFRDAVLAGEVKHDNNPVLKAHITNAHQHPTIYDAISIRKPGKESKRKIDAAVTAVLAWGSRQDFLLSKSNTGKGAGLLR

SEQ ID NO: 512 - protein, 572 aa, Mycobacteriophage Bethlehem
  MP-Be gp51 precursor
MTQRIVFLPDTQLPYEARKEMQAVIRFIGDVQPYGVVHIGDILDLPQPSRWNKGTKGEFEGSVYRDADYAKKHLLEPLRKVYDGWIGAHEGNHDCSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDYPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGNSRARDYLSKNAPALEGTHAFDIDVLLDFDGFGVELLPDFYDIAPGWISTHGHMGKMTLSQIAGSTALNGAKKFGKSVVCGHTHRQAVVSHSFGYGGSVRKTVTGMEVGHLMDMKKANYLKGGAGNWQMGFGMLTVDGKHVKAEIVPILGGKFTVDGRVWEV

SEQ ID NO: 513 - protein, 587 aa, Mycobacteriophage Catera
  MP-Catera gp206 precursor
MGKEGRKSIFRSLAERDLLIPYFRNALLSQEWPDEYTIKVDSSPYYGKGDGYFHPSTHALMPARQLYYHFHPETRDKIVQEDRTITQEMTLTMGSAIHAVVQTQFQMAGLIKGPDDCEVEYVDRTHHVRGRVDFIVHHPNGQVIPVELKSLACSTPILTTNGWSTMGALQDGDEVYAPDGQPTKVIKAHPINLNRPCFKVRFRDGQEVVTDAEHLWQVNDRNNGGRDRVMTTQEIADAPWGGRYRFRVPVTEPLQTPEADLPVDPWLLGAWLGDGDASMVSICSGSQDLDYLISRVEGLGLSHRVNRYGSRAASVYVHGMRAVFSELGLLKNKHIPDRYLTASVAQRRQLLAGLMDSDGTVSDRQVTISMKNERLMRQVLQLVRSLGYRAGFGSRMARLNGRDCGLVYVVRFHTGWGESPFDMPRKRDGWEQATKTSVQNLRLNAIVAVEPVETVPVRCITVAHESSLYVAGEGFVPTHNTQNSRSFDFQDTIKPIWDAQLSLGLHGTGHPLGILLVVESGYPFRMREYRVPRNDQLLTQIFQKFDYVRECIALNKVPEYCCMPQSKEMDACPARYQCWLKDKVEAS

SEQ ID NO: 514 - protein, 887 aa, Mycobacteriophage CJW1
  MP-Mcjw1 DnaB precursor
MEVCGYTLDDIECTEVGAHFCVPRANKAQAFFEEILVHTKGQYTRKKFILEDWQRDDIVRPLFGRVEYSDEFGCYKRRYEIAWIELARKNGKALDVETPILTGNGWKKMGDIQVGDYVHAADGTLARVSYVSERHWRDCFSVQFADGAELVASDHHLWAVNDRLKGERVIDTAELYRTQTYGARGDRRYTVTVPEALDRDEAPLPLDPYILGAWLGDGTATRAEFTSEDPEIFAAIEAAGYPLSYDYASGNARTRGAKGLVAVLRKMGVLGAKHVPQDYLIGSRAQRLALLQGLMDTDGSVITGPNTPRVEFCNTNRDLAEAALFLARSLGWKATLKESRARLNGKDCGPRFRVSWTAYSDMSPFRLQRKSEKLAAAPARATRARTNTITSVTPVPTVETVCIQIDHPSHVFLAGKSLTPTHNTELLAGIMLYLLVADGEQSGEIYGVARDKKQAALAFDVAAQMVKFSPILSKRLKVVDYKKRIYDAKTNSFYDVIAADAKSALGSNPSGCGADEILAWQDGGMWDSLRTGMGSGARVQPLMVASTTAGNDTEGFAGLKHREMERVMEDPDNPDFKHIFVYMRNTPMEEDPWNEECWPHANPALGRFLSWEAMRKQAAEARNNPIAEMAFRQFKLNQWQNSTIRWMRMPAWDECKGTVFKSNKDLFDAFAGQSCWFGLDLAARRDLCSICYLFPQSDGSVDLLWRHWIPESALAKLDRLNDGRFAKEFVPGGWLKVTEGDVLDFDVVYDDIEADAKRFTILGGDADQWSSDPVIQEIEKRTYLYEDIFAYKNDFAHMSDSMHRIFEWTLAKNLRHHGNPLARFCFSACEARVAAYDPNLIRPDKPDRDMAAKRIDAVPTAVMATNAFYTRGNDYDSVYEEREALSV

SEQ ID NO: 515 - protein, 850 aa, Mycobacteriophage Omega
  MP-Omega DnaB precursor
MGVQEPRIWLSPEAKSSAGQEAIDLAAACGLILDPWQELCLHEALKESEELVQLESGAWVKKWAASSFGLVVSRQNGKGSILEALELAGLILFGERLIIHSAHEFKALAIDTPILSERGWTTMGDLVDGDRVYGPDGQLTNVIAHPIRYERPCYRLTFDDGQTIVADEDHLWTVYDAVKREHRTLTVRELVDGGVFTTRRNAGRADSNIYRYRVPVTEPLAGVEADLPVDPYLLGYWLGDGDTNAGRFTVGEEDLEAFKLTLESLGYEYSDSVDPRTGAHTICAYGFIQGLREAGVVGNKHIPETYLTASMEQRRALLAGIMDSDGGVTGHQISVTMKNEALMRQVLMLARSLGYKSFFTSHLSMLNGEHKARVYRVKFANRQELNPFRLPRKAAKVLPPLGRVTRAQYNAIVSIEPVESVPTRCITVDNDSRLYVVGHGFVPTHNTAVNGMERLESLIAKSGLKYKAKQAHGAESIEILDGPNPGARVMFQTRTDRSGLGLTADRVIFDEAMTITPGSLKALLPTVSSRPNPQIVYTGTAADQRTQPYCHTFGGVRYRALEQLRTGERKRLCFLEWSAPDDLPEEKFGDPQYWAMANPGLGYRQTEEKILDEYEEMWANLRDFGVDRLGIGDWPQFGAEMSEIPLDKWRRLNNPSPDLAGARALILYRTPEGGPWAIVGSQRCTDGRIHVEVGYAGTDPVDRVVDKFIQAITAWGPEEILVGRGGAAEVIPQIEAAGFTVYSPNQSEEAQACGGFLNDALVDPENPLLSHGDQHSLNAAITRAVKRDLPSGGFVWDCIEPSTYAQLMGVTLGRWALLKHAINAKPTPAIHDWPDQQEIDSWIQELYEEA

SEQ ID NO: 516 - protein, 572 aa, Mycobacteriophage U2
  MP-U2 gp50 precursor
MTQRIVFLPDTQLPYEARKEMQAVIRFIGDVQPYGVVHIGDILDLPQPSRWNKGTKGEFEGSVYRDADYAKKHLLEPLRKVYDGWIGAHEGNHDCSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDCPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGNSRARDYLSKNAPALEGTHAFDIDVLLDFDGFGVELLPDFYDIAPGWISTHGHMGKMTLSQIAGSTALNGAKKFGKSVVCGHTHRQAVVSHSFGYGGSVRKTVTGMEVGHLMDMKKANYLKGGAGNWQMGFGMLTVDGKHVKAEIVPILGGKFIVDGQVWEV

SEQ ID NO: 517 - protein, 423 aa, Mycobacterium shimodei
  Msh RecA precursor
REKIGVMFGCMNYSTRVTLADGSTEKIGKIVNNKMDVKVLSYDPDSDRIVPRKIVNWFNNGPAEQFLQFTVEKSGGNGKSQFAATPNHLIRTPAGWTEAGDLNTGDRVLAAEPHLLSDQQFQVVLGSLMGDGNLSPNRRDRNGVRFRLGHGAKQAEYLQWKTALMGNIGHTVRENAKGASFVDFTPLPELAELQRAVYMGDGKKFFSEEYLKALTPLALAIWYMDDGSFTLRSRGLQERTAGGSGRIAICVEAMTEGTRVRLRDYLRDTHGLDVRLRSAGSAGKTVLVFSMAATAKFQELVAPYMAPSMEYKLLPRFRGRSTVRPQFVEPTQRLVPARILDVHVKPHTRSMNRFDIEVEGNHNYFVDGVMVHNSPETTTGGKALKFYASVRMDVRRIETLKDGTDAVGNRTRVKVVKNKVSPP

SEQ ID NO: 518 - protein, 782 aa, Mycobacterium species KMS
  Msp-KMS DnaB precursor
MAVVDDRGHPDMDAPPPSEDFGRQPPHDAAAEQAVLGGMLLSKDAIADVLERLRPGDFYRPAHQNVYDAVLDLYGRGEPADAVTVAAELDRRGLLRRIGGAPYLHTLISTVPTAANAGFYAGIVAEKALLRRLVEAGTRVVQYGYAGADGADVADVVDRAQAEVYDVVDRRSSEDFAVLESLLQPTMDEIDAIASQGGIARGVPTGFTELDELTNGLHSGQMVVIAARPGMGKALALDTPLPTPDGWTTMGEVEVGDELIGADGRPTRVVAATDVMVGRPCYEVEFSDGTVIVADAQHQWLTDTRASGRSARVAAAVRTTEQIAATLRCPTADRRLNHSVANAAPLQAPTRELLVPPYTLGAWLGDGTSAAAQITTADPELVMRIEAEGVEFGTLQGRLRTIGVLGDKHIPIEYLRASESQRRALLAGLLDTDGTVAVGGGVQFSVTNKRLAADVAELVVSLGYRCRSTTKHVKGRSADSSVAYTLNFSTDDDVFGLARKAILHKERRGASTTVRSDSRFIVDVRPVRSVPVRCVEVSNDSHMYLAGRSMVPTHNSTLGLDFMRSCSIKHQLPSVIFSLEMSKSEIVMRLLSAEAKIKLADMRSGRMSDDDWTRLARRMSEISEAPLYIDDSPNLTMMEIRAKARRLHQKAGLRLIVIDYLQLMTSGKKVESRQQEVSEFSRNMKLLAKELEVPVIAMSQLNRGPEQRTDKKPMLSDLRESGAIEQDADMVILLHRPDAFERDDPRGGEADLIVAKHRNGPTKTITVAHQLHLSRFANMAHA

SEQ ID NO: 519 - protein, 1257 aa, Mycobacterium species KMS
  Msp-KMS GyrA precursor
MTDTTLPPGDEAGDRIEPVDIQQEMQRSYIDYAMSVIVGRALPEVRDGLKPVHRRVLYAMFDSGFRPDRGHAKSARSVAETMGNYHPHGDSSIYDTLVRMAQPWSLRYPLVDGQGNFGSPGNDPPAAMRYCVTGDALVRLPLGQSVRIDGVVPGAKPNSDNPIDLKVVDRHGDPVAADRLFHSGEHQTYKVTTTEGYTVTGTENHPLLCLVDVGGVPTLLWKLVEEIRPGDTVVLQRSQPMEFGPADWQETLEALLAGAFISEGFISEKRAGFNNLDRDFFNMVVAAYDAVVGGRRYVSSRTIASGSLLHELDIHNLESLRRSRLGVAVGQRSADKFVPEWIWQSPAAVKRVFLQALFEGDGSCSRLPRNTIQVSYSTRSERLAADVQQMLLEFGIVSRRYRHAVGEYKVALTNRAQAELFARQIGFGGAKQVKLLEILSALPEEAAGLDRDFVPGLARFIRQHSGGRWADKEWLRKHNVDRISRWQRNGAEILGRIADPEVRAVATDLTDGRFYYATVASVADAGVQPVYSLRVDTEDHAFITNGFVSHNTEARLTPLAMEMLREIDEETVDFIPNYDGRVQEPTVLPSRFPNLLANGSGGIAVGMATNIPPHNLRELADAVYWCLENFEADEETTLAAVMERVKGPDFPTHGLIVGSQGIEDTYKTGRGSVKMRGVVEIEEDSRGRTGIVITELPYQVNHDNFITSIAEQVRDGKLAGISNIEDQSSDRVGLRIVVELKRDAVAKVVLNNLYKHTQLQTSFGANMLSIVDGVPRTLRLDQMIRYYVEHQLDVIVRRTRYRLRKANERAHILRGLVKALDALDEVIALIRASQTVDIARAGLIELLDIDEIQAQAILDMQLRRLAALERQRIVDDLAKIEAEIADLEDILAKPERQRAIVRDELKEIADKYGDDRRTRIVPADGEVSDEDLIAREDVVVTITETGYAKRTKTDLYRSQKRGGKGVQGAGLKQDDIVNHFFVCSTHDWILFFTTQGRVYRAKAYELPEASRTARGQHVANLLAFQPNERIAQVIQIKSYEDAPYLVLATRNGLVKKSRLTDFDSNRSGGIVAVNLRDGDELVGAVLCSSEDDLLLVSAKGQSIRFSATDEALRPMGRATSGVQGMRFNADDELLSLNVVRPDTYLLVATSGGYAKRTSIEEYTAQGRGGKGILTIQYDRRRGNLVGALIVDDDTELYAITSGGGVIRTAARQVRKAGRQTKGVRLMNLGEGDTLIAIARNAEAGDSTDEVNTDPDAV

SEQ ID NO: 520 - protein, 782 aa, Mycobacterium species MCS; identical to SEQ ID NO: 518
  Msp-MCS DnaB precursor

SEQ ID NO: 521 - protein, 1257 aa, Mycobacterium species MCS; identical to SEQ ID NO: 519
  Msp-MCS GyrA precursor

SEQ ID NO: 522 - protein, 703 aa, Methanothermobacter thermautotrophicus (Methanobacterium thermoautotrophicum)
  Mth RIR1 precursor
MISLSTTALKVLEERYLLRGEGGEVVETPEEMFRRVARAVASADEAYGDDPAVAEEAFYSVMGNLEFLPNSPTLMNAGTPINQLSACFVLPVEDSIDSIFSSLRDMAIIHKSGGGVGFSFSRLRPRGDIVASTMGVASGPVSFMRIFDVAVDVIKQGGRRRGANMGVLHVSHPDIFSFIDAKSREGPLRNFNLSVAVPDEFMDDRPVDLINPRNGEVVDSVESRVILKRIVEAAWRSGDPGILFEDRINRYNPTPQLGRIEATNPCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHNCGEQPLLTHESCNLGSVNLSLMVGPSGINWEKLRRTIHVAVHFLDNVIDVNSYPLRPVEEMTLRTRKIGLGVMGFADMLIKLGIPYNSVAALEVAGRVMSFISSEARRASMELARERGSFPEFKGSIWDIQGFECMRNATLTTIAPTGSLSIIAGTSSGIEPLFAVSFTRNILGRSFHELHPLFKTMAGRLDKRSLEAIESRGSLRGVPGVPARIRRLFVTAHEIDPVFHVKMQAAFQRYVDNAVSKTVNLPADSSPADVERVFRAAHELGCKGVTVYRYGSKVDEVLRFPEYAGSCRDMTCPN

SEQ ID NO: 523 - protein, 424 aa, Mycobacterium thermoresistibile
  Mthe RecA precursor
REKIGVMFGCFDYSTRAQLADGTTEKIGKIVDNKMDVEVLSYDPDTDRIVPRKVVNWFNNGPAEQLLQFTVEKSGGNGRARFAATPNHLIRTPGGWTEAGDLIAGDRVLAAEPHRLSDQQFQIVLGSLMGDGTLSPDPRGRNGVRFRMGHGADRVDYLEWKTALLGNIKHSTGENAEGARFVDFTPLPELAELRRAVYLGDDGRKFISEEYLKALTPLALAIWYMDDGSLTVRSEGLQQGTAGGSGRIEICVEAMTEGSRIRLRDHLRDTHGLDVRLRQAGAGGKAVLVFSTAATAEFQELVAPYMAPSMEYKLLPRFRGQSRVVPQFVEPTQRLVPARILDVHVEPHTRSMNRYDIEVEGNHNYFVDGVMVHNSPETTTGGKALKFYASVRIDVRRIETLKDGTEAVGNRTRAKIVKNKVSPP

SEQ ID NO: 524 - protein, 846 aa, Mycobacterium tuberculosis strains H37Rv & CDC1551; identical to SEQ ID NO: 471
  Mtu SufB (Mtu Pps1) precursor

SEQ ID NO: 525 - protein, 874 aa, Mycobacterium tuberculosis, CDC1551; identical to SEQ ID NO: 470
  Mtu-CDC1551 DnaB precursor

SEQ ID NO: 526 - protein, 874 aa, Mycobacterium tuberculosis H37Rv
  Mtu-H37Rv DnaB precursor
MAVVDDLAPGMDSSPPSEDYGRQPPQDLAAEQSVLGGMLLSKDAIADVLERLRPGDFYRPAHQNVYDAILDLYGRGEPADAVTVAAELDRRGLLRRIGGAPYLHTLISTVPTAANAGYYASIVAEKALLRRLVEAGTRVVQYGYAGAEGADVAEVVDRAQAEIYDVADRRLSEDFVALEDLLQPTMDEIDAIASSGGLARGVATGFTELDEVTNGLHPGQMVIVAARPGVGKSTLGLDFMRSCSIRHRMASVIFSLEMSKSEIVMRLLSAEAKIKLSDMRSGRMSDDDWTRLARRMSEISEAPLFIDDSPNLTMMEIRAKARRLRQKANLKLIVVDYLQLMTSGKKYESRQVEVSEFSRHLKLLAKELEVPVVAISQLNRGPEQRTDKKPMLADLRESGCLTASTRILRADTGAEVAFGELMRSGERPMVWSLDERLRMVARPMINVFPSGRKEVFRLRLASGREVEATGSHPFMKFEGWTPLAQLKVGDRIAAPRRVPEPIDTQRMPESELISLARMIGDGSCLKNQPIRYEPVDEANLAAVTVSAAHSDRAAIRDDYLAARVPSLRPARQRLPRGRCTPIAAWLAGLGLFTKRSHEKCVPEAVFRAPNDQVALFLRHLWSAGGSVRWDPTNGQGRVYYGSTSRRLIDDVAQLLLRVGIFSWITHAPKLGGHDSWRLHIHGAKDQVRFLRHVGVHGAEAVAAQEMLRQLKGPVRNPNLDSAPKKVWAQVRNRLSAKQMMDIQLHEPTMWKHSPSRSRPHRAEARIEDRAIHELARGDAYWDTVVEITSIGDQHVFDGTVSGTHNFVANGISLHNSLEQDADVVILLHRPDAFDRDDPRGGEADFILAKHRNGPTKTVTVAHQLHLSRFANMAR

SEQ ID NO: 527 - protein, 790 aa, Mycobacterium tuberculosis H37Rv,Also CDC1551; identical to SEQ ID NO: 472
  Mtu-H37Rv RecA precursor

SEQ ID NO: 528 - protein, 790 aa, Mycobacterium tuberculosis So93/sub_species="Canetti"
  Mtu-So93 RecA precursor
MTQTPDREKALELAVAQIEKSYGKGSVMRLGDEARQPISVIPTGSIALDVALGIGGLPRGRVIEIYGPESSGKTTVALHAVANAQAAGGVAAFIDAEHALDPDYAKKLGVDTDSLLVSQPDTGEQALEIADMLIRSGALDIVVIDSVAALVPRAELEGEMGDSHVGLQARLMSQALRKMTGALNNSGTTAIFINQLRDKIGVMFGSPETTTGGKALKFYASVRMDVRRVETLKDGTNAVGNRTRVKVVKNKCLAEGTRIFDPVTGTTHRIEDVVDGRKPIHVVAAAKDGTLHARPVVSWFDQGTQDVIGLRIAGGAIVWATPDHKVLTEYGWRAAGELRKGDRVAQPRRFDGFGDSAPIPADHARLLGYLIGDGRDGWVGGKTPINFINVQRALIDDVTRIAATLGCAAHPQGRISLAIAHRPGERNGVLDLCRRAGVHGKLAWEKTIPNWFFEPDIAADIVGNLLFGLFESDGWVSREQTGALRVGYTTTSEQLAHQIHWLLLRFGVGSTVRDYDPTQKRPSIVNGRRIQSKRQVFEVRISGMDNVTAFAESVPMWGPRGAALIQAIPEATQGRRRGSQATYLAAEMTDAVLNYLDERGVTAQEAAAMIGVASGDPRGGMKQVLGASRLRRDRVQALADALDDKFLHDMLAEELRYSVIREVLPTRRARTFDLEVEELHTLVAEGVVVHNCSPPFKQAEFDILYGKGISREGSLIDMGVDQGLIRKSGAWFTYEGEQLGQGKENARNFLVENADVADEIEKKIKEKLGIGAVVTDDPSNDGVLPAPVDF

SEQ ID NO: 529 - protein, 863 aa, Mycobacterium vanbaalenii PYR-1
  Mvan DnaB precursor
MEPPPSEDFGRQPPQDAAAEQAVLGGMLLSKDAVADVLEKLRPGDFYKPANQLVYDAILDLYGRGEPADAVTVAAELDRRGLLRRVGGAPYLHTLISTVPTAANAGYYAEIVAEKSLLRRLVEAGTRVVQYGYAGADGADVNEIVDRAQAEIYDVTERKSSEDFVILEEILQPAMDEIDAIASEGGVSKGVPTGFTDLDELTNGLHPGQMIVVAARPGMGKALALDTPLPTPTGWTTMADVAVGDLLIGADGKPTRVVAATEVMVGRPCYEVEFSDGTVIVADAEHQWLTETRASRKSAQAAAVGYNRYKNQRTFAAVRTTREIGETLRCPTADRRLNHSVVNAAPIEAPVADLLLPPYTLGAWLGDGTSRAAQITTADPEILMRIEAEGLVTVPLPGARMRYGLQLPTEAPAGTRECVVCGASFTPSTSQVRTCGRSCGGRARFVSEPVAAPTCSHCGGPSCGLRLCQSCRNAVGTVQGRLRTIGVLGNKHIPTEYLRASEAQRRALLAGLLDTDGTVTNGGAVQFSVTSRRLAADVAELVVSLGYRCQVATKAVKGRTEASSTAYILNFSTTDSVFGLHRKDLSHKERRSKSSVRSNTRFIVDVREIETVPVRCVEVDNDDHMYLASRSMIPTHNSTLGLDFMRSCSIKHHLPSIVFSLEMSKTEIVMRLLSAEAKIKLADMRSGRMNDDDWTRLARRMSEISEAPLYIDDSPNLTMMEIRAKARRLKQKADLRLVVIDYLQLMTSGKKVESRQQEVSEFSRQIKLLAKELEVPVVAMSQLNRGPEQRTDKKPMLSDLRESGSIEQDADMVILLHRPDAFESDDPRGGEADLIVAKHRAGPTRTITVAHQLHLSRFSNMAK

SEQ ID NO: 530 - protein, 885 aa, Nocardia farcinica IFM 10152
  Nfa DnaB precursor
MTTTDDRGHTDFPPEPPGEDFGRQPPHDMAAEQSVLGGMLLSKDAIADVVEVIRPGDFYRPAHQAIYDTILDLYGRGEPADPVTVAAGLDRRGELKRIGGAPYLVTLTQTVPTAANAGYYAEIVAEKAILRRLVEAGTRIVQYGYAGADGQDIAEVVDRAQAEVYEVTERRTTEDFLPLEELLQPTMDEIDSIASRGGISLGVPTGFSELDELTNGLHPGQMIIVAARPGVGKSTLGMDFMRSCSIKHGLASVIFSLEMSRTEIVMRLLSAEAKIKLADMRSGRMSDDDWTKLARRMSEISEAPLFVDDSPNLTMMEIRAKARRLKQRHDLKLVVVDYLQLMTSGKKVESRQQEVSDFSRNLKLLAKELEVPVVAISQLNRGPEQRTDKRPMVSDLRESGCLPASTRILRADTGAESTLGELLASGEQPLVWSLDERMRMVARPMVKVFPSGRKEVFRLRLASGREVEATGNHPFLTVDGWIPLDRLTVGDRLATPRSVPEPVHTERMADAEVVLLAHMIGDGSCVRRQPVRYASIDEQNLAAVSEAAEHFGVTAVRDDYAAARVTTLRLPAPYRLSRGKRNPIAAWLDELGLFGLRSHEKFIPRRVFALPNDQVALFLRHLWATDGSVRWDSTYRQARVYYTSTSRRLIDDVAQLLLRLGVHGRIRRVTKPGYRDAWHLTIDGADNQTVFLRDVGVHGARGDAAQVALAELEPLVRNTNVDTVPNEVWNQVRHLLATKNITHREFSAAMGSRFCGSTMWKRSPSRSRLARVAAVLDDADIEMYATNDVFWDKIVEITSLGEQDVYDGTVPGTHNFVAQSISVHNSLEQDADMVILLHRPDAFERDDPRGGEADLIVGKHRNGPTATITVAHQLHLSRFVDMARG

SEQ ID NO: 531 - protein, 1102 aa, Nocardia farcinica IFM 10152
  Nfa RIR1 precursor
MLNLYGPDGKIQFDKDREAARQYFLQHVNQNTVFFHNLDEKLDYLVEENYYEPEVLDRYSRAFVKSLFQQAYDKKFRFPTFLGAFKYYTSYTLKTFDGKRYLERFEDRVCMVALTLAAGDEELARKLVDEIIDGRFQPATPTFLNSGKKQRGEPVSCFPAGTPVDTIDGPKPIESLRAGDRVLSHDGSYATVEKLIENTNDQPLVSISHFGHKEPIRCTPEHPILVWTDRDVETLIDGDGADPFNGFVWLAAQDVHPSDFIVATAPLETRERRVFDLMNHVGEGTYEEVDGLIRKVNTDARHRNKQRHRQGFVAVTRYVEESYDLGLILGWYLAEGHVSKRSGVEDVRPTGVHFTLGANEIERHVELGMAFKQVFGVDLVLHTNHSDHSTRMVCNSKIVASLLLSLAGTGYSTKRLAHEVMTADEDFQRGLLVGLFRGDGCTTTGGMVLDLVNQELIDQVQLLLRRLGIVSVVRTYTNQAGNPTGQVFVPGLPGTNEEFIFDVDKNLQNYTGRKGTKRTTYQVVHGRHVYGIRAVERTGETPRQVYNLHVEGTHTYTIRGAVVHNCFLLRIEDNMESIGRSINSALQLSKRGGGVALLLSNIREHGAPIKKIENQSSGVIPIMKLLEDSFSYANQLGARQGAGAVYLHAHHPDIYRFLDTKRENADEKIRIKTLSLGVVIPDITFELAKKNEDMYLFSPYDVERIYGKPFADIDVTEKYYEMVDDKRIRKSKIKAREFFQTIAELQFESGYPYIMFEDTVNRANPIAGKITHSNLCSEILQVSTPSEFNDDLSYAKVGKDISCNLGSLNIAKAMDSPDFAQTIEVAIRALTAVSDQTHITSVPSIEQGNQQSHAIGLGQMNLHGYLARERIHYGSDEGIDFTNMYFYTVVYHALRASNRLAIERGTYFGGFPESKYASGEYFDKYTEQVWEPKTERVRQLFADAGVRIPTQDDWRELKASVMEHGIYNQNLQAVPPTGSISYINHSTSSIHPVASKIEIRKEGKIGRVYYPAPYMTNDNLEYYQDAYEIGYEKIIDTYAAATQHVDQGLSLTLFFKDTATTRDLNKAQIYAWRKGIKTLYYIRLRQMALEGTEVEGCVSCML

SEQ ID NO: 532 - protein, 539 aa, Neosartorya fischeri
  Nfi PRP8 precursor
TAFPSWEGLFWERACLAKGTRLLRYDGSEIEVQDVKEGDLLLGPDGGPRRAFNIVNGEDRLYRIKIDGSKEDLVVTPNHILVLHREKRATTFESMPSTNAEEPGNGDDDELPEVSAAERYDTVEMTAAEFAALSTEERSRYRVFRCPGFELPEQSVPVNPYFLGLWLGDGNSRSTTIYNSHGETVREFLVNHAAELDMYLTWHGQLGYATVPDTIEHRPVVRQARQTIRKLRLAAKSIAQPEVSEGLMPSQGSTEEPSQASTIKPVHQASMVEQKADLDLLETDSEDEEADSADEDELGDPDASEFRPEPESQLSQSHFSNRRRNHRLRTGRRAYGDLNGDEEDELLHQIVEQSEGSRVDSLPRALDALGVIAQKETGPETDRKHIPSIYMKNSRSVRLAVLAGLIDSDGWYVYPENMLGFAQSERCHSKLFWDVVALARSLGLSVWTKRHMMWNPARTERYPQLFAQISGNVAEVPCLLARKKGVERLIPQTHSFMIKDISLEPETTEWAGFRVDKDQLYLRHDYLVLHNSGFEESMK

SEQ ID NO: 533 - protein, 217 aa, Neosartorya glabra FRR2163
  Ngl-FR2163 PRP8 precursor
FWWTSQRHDGKLWNLNAYRTDVIQALGGVETILEHTLFKATAFPSWEGLFWERACLAKGTRLLRYDGSEVEVQDVKEGDLLLGPDGGPRRAFNIVSGEDRLYRIKIDGSVEDLVVTPNHILVLHRESAAESYDTVEMTAAEFAALSTEERGRYRAFRSPSFELSEKAVRVNHRFMIKDIRLELETTEWAGFRVDKDQLYLRHDYLVLHNSGFEESMK

SEQ ID NO: 534 - protein, 231 aa, Neosartorya glabra FRR1833
  Ngl-FRR1833 PRP8 precursor
FWWTSQRHDGKLWNLNAYRTDVIQALGGVETILEHTLFKATAFPSWEGLFWERACLAKGTRLLRYDGSEIEVQDVKEGDLLLGPDGGPRRAFNIVNGEDRLYRIKIDEGIEDLVVTPNHILVLHREKKAGNNEDDGLPEVSAAERYDTVEMTAAEFAALSTEERSRYRAFRCPGFELSEKAVPANHSFTIQDIRLELESTEWAGFRVDKDQLYLRHDYLVLHNSGFEESMK

SEQ ID NO: 535 - protein, 1037 aa, Natronomonas pharaonis DSM 2160
  Nph CDC21 precursor
MARAEDTEIIDKFEQFYRDYYRDEIGQLAQKYPEDQRSLYIDWDDLYRFDADLADDLVAQPDQIRDYAEEALRLYDLPVDVQLGRAHVRVHNLQQTTGIRDIRARHRGNLVEVTGIVRKATDVRPKITEAAFECQRCGTLTRIPQTAGDFHDPHECQGCERQGPFDINFDQSEFVDAQKIRVQESPEGLRGGETPQSIDVHIEDDITGKVTAGDHVRVAGVLHLDQQGSEQEKSPVFDVYMDGMSVEIEDEQFEDMDITDEDKQRIIELSNDDGIYQQMVESMAPSIYGYEQQKLAIIMQLFSGVTKDLPDGSRIRGDLHMLLIGDPGTGKCVDGDTSVTLASGDEKPIRDIVESTLEDPTEISDGFYQESDIDVLTTDGGAVAPGRATKVWKRQAPEKMYRIRTESGRELEVTPSHPLFVQSEGGLSPLVADDLSENDFVAVPRALPADDGDDFGQHVDDLGSVTARKTADAEAVRSEDAATTPDVIPNVGDQLRRIRTSLRLSQHDCGLPRSTYQQYERGDRNPSRSRLQTVLTAFERRIEQLSSLSDRVDDGDSDAIAAARDELNPSQASLASGMDATRTAIGDDERTEARPDGGAVADAERAVADALCRALAVADDVERLRSLADGDIGWDRIDSIEPVEPEDEWVYDLEVESTHSYLSNDVVSHNSQLLQYVKNIAPRSVYTSGKGSSSAGLTAAAVRDDFGEGQQWTLEAGALVLADQGIAAVDELDKMRSEDQSAMHQALEQQEISVSKAGINATLKSRCSLLAAANPIHGRFDEYEPFAEQIDLDPPLISRFDLIFTVTDQPDEEEDRQLAEHIIETNYAGELQTHRTKAATSNVSQEQVDSVTEDVAPAIDDELLRKYVAYAKRNCYPTMTEEAKEAIQEFYVDLRLEGQSEDNPVPITARKLEALVRLAEASARIRLSDTATKDDAERVIEIVRSSLEDVGVDPETGELDADIIESGTSKTQRDRIKNIKSLISEVETEYDEGAPIDVVLDRAEEMGMDRSQAEHEIEKLRRQGDVYEPQTDHLRTV

SEQ ID NO: 536 - protein, 1740 aa, Natronomonas pharaonis DSM 2160
  Nph PolB-1 precursor
MEQGTLGDFDTGASDDADAGRPAAEAAAVAGSDDGDASVVDVADYEFPDADGQIECAVTQVDYTVEGGGDDEHPVLHVFGRRPNDGDDEPLHIRVYGFKPYFYTPLSELDIADSAEAPLTEADIVDSRLDHDRLTGVETEADDGDGPNELVVYESIRGEKLVKVFGQTPRDVGQLRDRFEHYEADILFPNRLLIDKDITSGVRAPNRELDDGSLKVHHSELTATAVDAESRLHILDIEVDDRHGFPEDGEEEIVCLTSYDSYRDEYVIWLSESDDGVGGPEALGGYDPIGDGPLDVDVRRFDEEATMLVDYLDYIEDTDPDVLSGWNFDDFDAPYLIDRIDRIASRHDRLYSDRLSRVREVWDSGWGGPNIKGRVVFDLLYAYQRTQFSELDSYRLDAVGEEELGVGKERYPGDIGDLWEDDPERLLEYNLRDVELCVELNRKQNIVEFWEEVASFVGCKLEDATTPGDAVDMYVLHKIHGEFALPSKGHQEGEEYEGGAVFDPISGVKEMVSVLDLKCFSGDTDVATPDGIKNIQEVAVGDPVYTLNPETFECEIKPVVDTQSYRNKYGELHHVAGRTHDFKVTENHRFLLSETVDLDSPGPDDYALSEYRELPEYERLAFPNHEPMAGATREEFDLAGAVDDGHAVVCAHDGRSAFRTAMPAGVEAALDRADGTSQLAATEEKTGTYRIPIDTYRERRDVIDEHADEVLLKYEREDNQIPTGFGMDDWLELVGWFVTAGRFAHEAKRIVLRRQDEEGRSAIRSLLERMELPYDADGTRVTVSNRVLYDWFVKNCGDGATETRLPEWVFELDAAHLRTLLETLVDGDGSRTDSGLGEFWTQSDRLKDDVVRLAVRCGEKPTVSENQDGTWYVSVGTRGSMKKSNATVEDHDGDVHCITAEDNHVVLAGRNGHLQWVGQSLYPMCMVTINASPETKVDPDNYGAETYAAPNGTHFRKEPDGVIREMVDELLEEREEKKSLRNEHEPSTDAYETYDRQQSAVKVIMNCFTPDTEVLTPDGVRNIRALDIGDEVYSLDPETMEMEVKPVVDTHAYPDYRGELVDIQTGEIDFRVTPNHRMLVRKNGTNGITDDEYRFVEAGALDLATTYELPHDWAGPDGEDVTQIDLTELIDEEYEVWVRPEVHGRTFTAELGWKPRRVPKADIDTVGYVFTADEFKQHREYIESVCEQSYIRRESGLKWIPRVYDGDDFLELLAWYVTEGNAHTSERKEFDGQRHGSSTVQIAQEPVVADGGDTHATIGTLLDRMGFDYDNDNGSYQVTSKLLGDLFCTLGGGGSEDKRIPQLVFEASRRQKERFMQTLISGDGDRQPNSWQYNTASERLRDDVLRLCAHLGVPASYSEESGVYRIYVTEDGTNTLRMDRSAERTTADDGVYCVTVEDNHTLLAGRAGKFQFVGQSLYGVLGWDRFRLYDKEMGAAVTATGRDVIEFTEQAAAELDKDVIYGDTDSVMLELGNEVSEDEAIEQSFEIESHINDAYDRFAERLNAEEHRFQIEFEKLYRRFFQAGKKKRYAGHIIWKEGKEVDDLDITGFEYQRSDIAPITKEVQREVLEMIVTGEDPEDIKSYVHDVIERVREGDISHEELAIPGGIGKKLDNYETDTAQVRGAKYANRLLGTNFTSGSKPKRLYLAKVHPSFFRKMESEEGLDPSTDQLYGEFKREAESGEAVICFEYEDQIPDAFEVDYEKMLDKTLKGPIARVLEALDISWDEVESGQEQTGLGSFM

SEQ ID NO: 537 - protein, 1740 aa, Natronomonas pharaonis DSM 2160; identical to SEQ ID NO: 536
  Nph PolB-2 precursor

SEQ ID NO: 538 - protein, 894 aa, Natronomonas pharaonis DSM 2160
  Nph rPol A'' precursor
MTEITDDVEAIVEDTDLPRRLKDEVYETLESRSGVAPEDVEDIVQAVESQYLETRVDPLDPVGTVSAQSIGEPGTQMSIPADEQVVVRRNGETELTEIGPLVDSLMDSRETRSFDDHEVTLAPDGIEVPSLSSEETVEWKPIEEVSRHETPDELLRFELESGRSIRATKAHSFVTRQENEVVPVAGEELEAGDWLPVVASLDATDTQETVDLRKYLPAGDYWYTSVLADGGAEAVPGGPDQLRNKRAALEAGELAEHTAYPVQGTVGLPEQFPLDEETGFFVGAWLAEGSLADHYVSISNVDAAFQSRIRSFAERFDLTVNEYENDSGFAAGYDIRLNGTILSDFLRAACTDDGEKSIPGFAIGANEAFLKGLLQGYFSGDGNVGTNAIRSSSTSDRLTAGVGLLLARFDVYATLGQQEDSRTLRVPKKHVSRFDNRIGMVGERGAELEALAESADSDGPDATDQIPNFGDALEAVAEAADIPQRQVNSATKRQRIDRSRLARLVAAAEAELDGEQSELDALRQAVTGDVVWDRIESIETVESDHEYVYDVSVEGLETFTTADGVVTHNTMNTFHYAGVAEIDVTQGLPRLIELVDARKTPDTPMMTVHLEGEYARDRERAHEVVWKIEATKILALGDVSTNVADMLVQIDLNEETLAERWPTMESIDDIAGRIAGTIEGELGVDTARPKPTVIEFGPEEPSYRQLLQLVEELREIVFKGIEEINRVVIRKEETEQGEEFVLYTEGSDLKEVLDIEGVDASRTTCNNIHEIHNNLGIEAAREAIIEETMNTLEEQGLDDVNIRHLMLVADIMTNNGEIESIGRHGISGNKDSVLARAAFEVTVNHLLDAAIHGEVDDLDGVTENVIVGKPIKLGTGDVDLRMGATRDSGSRADD

SEQ ID NO: 539 - protein, 715 aa, Nostoc punctiforme
  Npu GyrB precursor
MPYEKLEITTPAPVLSWANHSLGPEETKMAKNVASLPFVFKHVALMPDVHLGKGALVGSVIATKEAIIPAAVGVDIGCFIGDTLIPLADGKSYRIKDLMDWGTEFIVYACTPTGKIVAAQATAKLTRRNAPLVKVILDNGEEIICTPDHQFMLRDGTYKEAQLLQAETSLMPFYSKTDKDGYTLITQPYSSRWQKAHWIIARSGLLGKVPRFEGQKTFIHHQNFDESDNRPENLEFMGNRDHSAYHRSLVERNQHWHSAEFEEKRVASLAQKAKTSEGYQYYAERGTRNIFQYMEQQPEHFKNAVAGNGNRGKQYLVEYNKTEKGRGKSQEIANRYYTCEICGVDVKTPIGLHNHRRKEHQCNHKVVAVNLLNYTEDVYCLTVPEYHNFALKAGVFVHNCGMSAIKTSFTAEQLEGKLKKIRLDIEAAIPTGFNENKDVEKSVSNWQHWDDFKDLHRGVQDLQGKAMKQMGSLGGGNHFIEVCLDTENQVWLMLHSGSRNIGNKLAQCHIYTARELAKMAGNKLPDPDLAHFVAGTREFQAYWHDLQWSQNYARVNRDVMMARFKHIVEKHLVGGKATKPLLQVNCHHNYAEKEVHFDEDVYVTRKGAVRAQTEDYGIIPGSMGAKSFIVKGKGNAHSFCSCSHGAGRLMSRNKAKNVYTLDDLIEQTNGVECRKDEGVLDEIPGAYKPIEQVMANQADLVEVVATLKQVLCVKG

SEQ ID NO: 540 - protein, 215 aa, Neosartorya quadricincta, strain NRRL 4175
  Nqu PRP8 precursor
AYRTDVIQALGGVETILEHTLFKATAFPSWEGLFWERACLAKGTRLLRYDGTEVEVQDVKEGDLLLGPDGGPRRAFNIVNGEDRLYRIKIDEGIEDLVVTPNHILVLHREKKARNNEDDELPEVSAAEPYDTIEMTAAEFAALSAEERGRYRAFRCPGFESPEKAVPVNHSFMIKDIRLELETTEWAGFRVDKDQLYLRHDHLVLHNSGFEESMK

SEQ ID NO: 541 - protein, 824 aa, Nocardioides species JS614
  Nsp-JS614 DnaB precursor
MSVTEQGPRGLPEPPIDDWGDGPAAYAPGERPTSPGDRTPPQDMAAEQSVLGSMLISKDAIADVAEVLRGVDFYRPSHETIHDAIIDLYGRGEPVDMVTVAAELQRRGELQRIGGAPYLHTLSANVPIAANAGYYAEIVREKAILRRLVDAGTKIVQIGYAGEGQVDDIVDTAQAEVYKITDRRAAEDYAPLSDIMDGVLDEIEAIGNREAGLYGVPTGFADLDDLTNGLHSGQMIIVAARPAMGKALALDTALPTPSGWTTMGDVQVGDQLYDAHGRPTTVVAATEVLTGRPCYEVEFSDGSRIVADAQHQWLTESRAARKSRWAADKQYNRARNQNIVASVVTTEAIAGTLRVGADQRANHAVLTADPLSGSDVDLPIPPYVLGAWLGDGHSASARITCETPEIPMYLEACGLRVDHQGAMLYSLKFPDGDPRGSVQGVLRTIGVLNDKHIPADYLRASEGQRRDLLAGLMDTDGTVVRGVGSCQFAVTNKRLADDVYELVVSLGYKCGRTTRRVQGRSPETSTCHILNFSTVDDVFRLERKHLLHKEERPVTRARIARRYITAVRPIESVPVRCVEVDNTEHLYLAGESMIPTHNSTLALDLCRAASIHNNLTSVFFSLEMTRSEITMRLLSAEAKVPLNHIRNGNMNDDDWAKLARKMGEVSSAPMFIDDSPNMTMMEIRAKARRLKQRHDLRLVVIDYMQLMTSGRKVESRQLEVSEFSRQIKLLAKELEVPIIALSQLNRGPEQRGDKRPMMSDLRESGSLEQDADMVILLHRDDVYEKESTRPGEADLIVAKHRNGPTRDITVAFQGHYSRFVDMAH

SEQ ID NO: 542 - protein, 932 aa, Nocardioides species JS614
  Nsp-JS614 TOPRIM precursor
MAGRIRDEDIAEVREKARIDDVVSQYVTLRPAGGGSLKGLCPFHDEKSPSFNVNPSRGFFHCLAGETKVLTWDGPRPISELAGGTHRILNVHGDWAEAPLKSYGVQRLWRIVVTRNRERKELFATDGHRWFVPSGRTGSKHREVLTKELKAGDRLVSKFPRSRIQRTTPSPFGIAHGFTYGDGTRSGTGSMALLRPPKDLAMLKWFSNSHTSASGDNLLVHHLPRFFKELPDPDESVSYLYGWLAGYFAADGCVAADGTVILNSARRENLEFVRMVTTRLGIATYGITTQSRVGLGKEHSDLHRVHFVNDDLTESFFLLDEHRRRFAEATKKYARRGWVVQAVEETDRVEEVYCAEVEDGHAFTLEDNILTGNCFGCSEGGNVITFLMKIDGLTFGEAVERLADKVGVQLRREEGDVREERPKGPPRRRLVEAHKVAQEYYADQLATPDALVARQFLGGRGFDQAAAEHFGIGFAPRDGDALKTHLRQKGFSAEEMTVGGLIGPSGYDRFRGRLLWPIRDASGDTIGFGARRIFDDDRIDAKYLNTSETPIYKKSQVLYGIDLARRDIGRSSQAVIVEGYTDVMACHLSGVTTAVATCGTAFGDDHSRVLRRFLNDHQVTHGEIIFTFDGDAAGQKAALRAFGGDQNFVSQTYVAVEPGGLDPCDLRIQQGDAAVRELVARRVPLYRFVLTNVVREFDLDRADGRIAAVREAAKLVLSSRDNSVAQSSFARDISELTGVDPNEVLVEVRRVVARHRNGDRGAVAEPPTNRSAVPSLHDPRFAIERETLQLVIQHPMTIGRSTGDIGPNDFVHPTYRAVWELVAAAGGPGAGAGDPSWANRLRDAATDPAASSVISALAVEPLKKEPDAAYVAEHVFRLLELTAARRIAAIKSKLQRTNPVEHAEEFNKMFGELAALEAHRRALRDRLAGSAT

SEQ ID NO: 543 - protein, 1172 aa, Nostoc species PCC7120, (Anabaena sp. PCC7120)
  Nsp-PCC7120 RIR1 precursor
MVRELERKRQSARFPESAPAANPVFFRTYSRRTEAGLRETWDEVCDRTLKDLIELGKLSPEEVAILDKTQRNLTALPSGRWLWVGGTDWINKSKNFSGAYNCTSTNLQDWKAFGLMMNLAMMGCGTGAVIEPEYINQLPPIRNHLNIIVKGEIGTTPKHLRREYTQTHIEGNSATIYVGDSREGWVESYQALLELSTDERFTDEVQVFVDVSDVRQSGETLNGFGGVANPVKLPGLYQRCAAILNKALGRKLNSVECCLLIDEGAVTIVAGNIRRCLPEDALVHTAKGLVPIRDVQVGDLVQTPLGFRRVVDKFDQGFQDVYEIETNATYPRATLNHRQAVLEDAKGGIVWKHIASLEAGDRLLHNKQVLPGTVTHLPADFTESRPSHSRTAKSFVVPELTAEVAWLIGFTHGDGYVALGRNKYDKPYGRVEWSMNSLDAEVTSRIQAKIDAALALFGLSAVHSITKGENTAKSICSSIRLAEYFHRHIKQPNIPLTVPSFILQGSVDIRAAYLAGLMDSDGAVNNRPPHLITSVYRSFIRQVSVVLSSLGIAGRLTTTYPQNSNWQVKYNLTIPALKERYNALISPHSAKGELRQGLKMYGFTVPGAVMRETYTYSEMREMGFQGSRTVDANYERYVAEADISLDIPVTVKGLGSYDHVQTYDIEVDEAHCFYCDGYLTHNSAGMRQFISDDQLGAAAKDNLWQQDENGRWRIDPERDSLRMANHTRVFHRKPTLEECVDAVRKQYYSGEGAIQWAGEAVARANIDLLPTQALKVEFLKAYEQGTAKDWLQKRHPHFDEKELKHRLARYALNPCGEIIGSNFHCNLSEIHLNQIDPFNYKEQEEAFTAGALSVATLLNHKFPEPRYQYSRELDPIVGVSFTGLFDFFVHAFGAEWLQWWEAGRPATPQGLAFKREEEKYLSSWREIVQRVVWDYCDRHNIKRPNRCTTVQPSGTKSLLTGASPGWHPPKAQRFIRRITFRKNDPVALACIDYGYNVIPSQSDKDEQGNLLNDPLDPRVSEWLVEIPVAVSWADIPGADTIDISKFNAIAQMDFYMQVQKFYVTHNTSATIEVREHEVETLGTQIWQAIQNDEGYISAALLARFDDHQTFPRLPFEPISKEQYEQMVKEVVQRRKTDDFYAVLSRYDFGDLMEVGPAGCDSDKCMMPEQSPN

SEQ ID NO: 544 - protein, 1112 aa, Pyrococcus abyssi
  Pab CDC21-1 precursor
MDREEIIERFLRFLREYAEEGEEPLYIGKIKDLLAITPKRSIAINWMHLNSFDPELAEEVLENPEECILAAEDAIQIILKEDIMREDVPRIHARFYNLPKTLMVKEIGAEHINKLIQVEGVVTRVTEIKPFVSSAVFVCKDCGHEMVVQQKPYEGFVAVKKCEKCGSKNVQLDVEKSKFVNFQMFRIQDRPETLKGGQMPRFIDGILLDDIVDTAMPGDRVVVVGILRVVQEKREKVPTFKKVIEVNYIEPVSKEIEELEITPEEEQKIRELAKRKDIVDAIVDSIAPAIYGYREVKKGIALALFGGVPRTLPDGTRLRGDIHVLLVGDPGVAKCVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHNSQLLRYIANLAPRAIYTSGKSSSAAGLCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNTAAVVRDEFTGGWVLEAGALVLADGGYALIDELDKMNDKDRSVIHEALEQQTISLSKAGITATLNARTTVIAAANPKQGRFNRMKRISEQINLPPTLMSRFDLIFVLVDEPDEKIDSEIARHILRVRRGESEVVTPKIPHDLLRKYIAYARKNVHPVISEEAMEEIEKYYVKMRKSVKKSSEEEIKPIPITARQLEALIRLSEAHARMRLSPIVTREDAREAIKLMEYTLRQIAVDETGQIDVTILEVGQSARKLSKVERILDIIEKLEGTSEKGAKIDDILEEAKKFGIEKQEAREILEKLLEQGQIYMPENGYYRTV

SEQ ID NO: 545 - protein, 1112 aa, Pyrococcus abyssi; identical to SEQ ID NO: 544
  Pab CDC21-2 precursor

SEQ ID NO: 546 - protein, 992 aa, Pyrococcus abyssi
  Pab IF2 precursor
MTKRIRQPIIAVLGHVDHGKCLLPDEKVVVPSVGFVTLKELFETASKVVERDDEKEIRELDERITSVNGDGKTGLVKASYVWKVRHKGKVIRVKLKNWHGVTVTPEHPFLTTKGWKRADQLRPGDYVAVPRFIHGNEDEKIFLSYVKVKKSGEEWKEYFYLAGRKGNIDVNLLFVAPKRYVVEFLRGYFEERSEVKGESVIVEARELVEPLSLALLRFGIFSKIQGSKLIVTGKRNLEAFKDYIGFKDEREKALEEAIEKVKGSEVYPIFEEIRRLRLLFGFTREELGSYAKYENSEAPTYEELMEILDFIERGSPSLSKKIAILEGKLKAELRVLEEEGLIKDGKLTPLGRELLEVWRNREFDSKDVDYIRNIAETLVFIPVENVEEEEYDGYVYDLTTETHNFIANGILVHNTTLLDRIRKTNVAAKEAGGITQHIGATEVPIEVVKKIAGPLIKLWKAEIKLPGLLFIDTPGHEAFTSLRARGGSLADLAVLVVDINEGFQPQTIESIEILRKYRTPFVVAANKIDRIKGWVIEEDEPFLMNIKKQDQRAVQELETKLWELIGKFYEFGFQANRFDRVQNFTRELAIVPISAKYGIGIAELLVLIAGLSQRYLEEKLKIEVEGPARGTILEVREEPGLGHTIDVIIYDGTLHKDDTIVVGGKDKAIVTKIRALLKPKPLDEIRDPRFRFDYVDEVTAAAGVKIAAPGLEEALAGSPVIAAPTPEDVEKAKQEILEQIERVVISTDKVGVIVKADTLGSLEALSKELQEKEIPIRKADVGNVSKTDVMEALSVKEEEPKYGVILGFNVKVNEDAEEVAKAKDVKIFVGNVIYKLIEDYEEWVKEEEEKKKRELLSKVTFPGVIRLYPDERYVFRRSNPAIVGIEVIEGRIKPGVTLIKQNGQKVGVIRSIKSRDEFLQEAKKGQAVAIAIEGAIVGRHIHPGETLYVDLSRDDAITLLKHLRDTLEDTDIKALKMIAKVKAKEDPFWRAI

SEQ ID NO: 547 - protein, 814 aa, Pyrococcus abyssi
  Pab KlbA precursor
MSEEKKKVRSWIDEILSGDNLTLEAILKKSESERKEEKKEETPLPKTESLSLASILAGVQKKEETEKETETLPFAVLEKTGGAPRLEDILKRSRPQERKEEGVGIQGILVPSSKYAGQVVRVLDVYGNVRIVRVKGEAVPIYEISVPELSREEEKLLKLVRDRAIVEIQIDPESIPNLEERRKVFLREVRKMVKEMAPTLSEGRVELLSELIVQNMIGYGKLDPLVRDDNLEEIMVIGIDRPVYVWHRRFGMCKTNIVFKTERELLTIIERIAREVGRRIDQQNPLLDARLPDGSRVNATLPPISLDGPTLTIRKFKKDPLTIIDLIKFRTLSSDVAAFLWLLVDGLGVKPANILVAGGTGSGKTTTLNSLAMFIPPSERVISIEDTAELQLPIEHWVRLETRPPNVEGKGEITMDDLVKNTLRMRPDRIIVGEVRGPEARTMFTAMNTGHDGALYYFSEIQLPNGKEFIGKLVDELFEKYHDKIGKYKDMEYVELNEEDTFEVISIGPDLSARRHKVTHVWRRKVKDGEKLVKIRTASGKELVLTQDHPVFVLLGRDVARRDAGNVKVGDEIAVLNTRPDFSVLSPPAMPELLSEPFNYELSSIGDVAWDEVVEVDEIDAKGLGVEYLYDLTVDINHNYVANGIVVSNCMGTIHSNSARETIIRLESPPMNVPKIMIPALDIIIMQVRYHTRKKGTIRRVTEIAEVSGIEGESIQLNFLYKYDPAKDELVRTEVPSRFLQILSYHTGMSLEEIHLEIEKRKLVLDWMIEKGLRRIDEVGAQIREFYIDEEEFFKKIQREAATMEISRRVKEFI

SEQ ID NO: 548 - protein, 998 aa, Pyrococcus abyssi
  Pab Lon precursor
MLKFYKMGIKRLSGEMTMGEERMDLGIEFETTEEIPVPERLIDQVIGQDHAVEVIKTAAKQRRHVLLIGEPGTGKSMLGQAMAELLPTEDLEDILVFPNPEDENMPRIKTVPAGQGRRIVEEYKRKAKEQENIRFYLLFFVFFIVAMAVFMSRGDPNTLLLGVFVILIALMVTANMRFRTQAMVPKLLVDNSGRKRAPFVDATGAHAGALLGDVRHDPFQCFSGEETVVIRENGEVKVLRLKDFVEKALEKPSGEGLDGDVKVVYHDFRNENVEVLTKDGFTKLLYANKRIGKQKLRRVVNLEKDYWFALTPDHKVYTTDGLKEAGEITEKDELISVPITVFDCEDEDLKKIGLLPLTSDDERLRKIATLMGILFNGGSIDEGLGVLTLKSERSVIEKFVITLKELFGKFEYEIIKEENTILKTRDPRIIKFLVGLGAPIEGKDLKMPWWVKLKPSLFLAFLEGFRAHIVEQLVDDPNKNLPFFQELSWYLGLFGIKADIKVEEVGDKHKIIFDAGRLDVDKQFIETWEDVEVTYNLTTEKGNLLANGLFVKNSGGLGTPAHLRVEPGMIHRAHKGVLFIDEIATLSLKMQQSLLTAMQEKKFPITGQSELSSGAMVRTEPVPCDFILVAAGNLDTIEKMHPALRSRIRGYGYEVYMRTTMPDTVENRRKLVQFVAQEVKKDGRIPHFTRDAVEEIIREAQRRAGRKGHLTLRLRDLGGVVRAAGDIAVRKGKKYVTREDVLEALQMAKPLEKQLADWYIERKKEYQVIRTEGGEIGRVNGLAIIGEQSGIVLPIEAIVAPAASKEEGKIIVTGKLGEIAREAVLNVSAIIKRYKGEDISRYDIHVQFLQTYEGVEGDSASISVATAVISALEEIPVRQDVAMTGSLSVRGEVLPVGGVTPKIEAAIEAGIKKVIIPKANEKDVFLSPDKREKIEIIPVERIDEVLEVALVESEKKKELIKRIRETLPLGVSESAGSETLHEHGRDSGSALSVEESKA

SEQ ID NO: 549 - protein, 1042 aa, Pyrococcus abyssi
  Pab Moaa precursor
MAETVGEIPSGEKEFEASTKRLREIIEFPELSEDEFHELLKSASRGYGSPLPHRTYSLCPETRRVVPAVVWEKDGKVWITKKCPEGMITDLYYEDVELYYRFSRWKFEEKKLFSVNVENTGVNCPFDCGLCARHRSHTSLLNIVLTNRCNLNCWYCFPPTEEAVFKFGDKVKIATFEEVAKNFKFEHKVEIDGFKGEYSIPNDLYVLTFNDGKAEWTRVTKFLRRKHEGKIRVIKTKTGRTIRTTPEHKFFVYKDGELVKKRADELEPGDELVLLWRFESEETLTEINLLEAFKDLPQEEKEKVYVRGIKDLDLTPLKEKYGDKVYYWARQDSMPLSVFYELNVDLDKEFRLGRDATTYELPSKLKITPSLAKLIGYFVSDGNYSDKDLRITVGHEDVEKEIVNILEELGLPYSFLEWEGKTKQIVIGSRLLRLVFKHVFKIPEGAPNKRLPEGFLSFPFEAKVALLSGLFNGDGYVVRGEHHLSIGYASTSKGLIRDILYLLASLGIFARVYRVPKEKMKGANHDLYKLYIAGTDLVRLVELLELREGHREKLGEIGNRKPARVKKIADFYIDVVDEVSEEEYSGYVYDLEVENEGHSFVAADGILVSNCFFYAREGEPIYEPTLEQIRMMLRNAKKEHPIGANAVQFTGGEPTLRDDLIEIIKIAKEEGYDHVQLNTDGIKLAFDPELVKKIRQAGVNTLYLSYDGMTPQTNWKNHWEIPLIFENVRKAGGPGIVLVPTLIRNVNDHEAGAIINFGLNHLDIVRGVNFQPISLVGRVPKKERQRFRITIAGAIKKIEEQTNGVISKDDWYPIPIAGHIARFFEVFTGSKYYMTSHFACGAATYVFLDREEKKVIPIPRFLDVEGFVEFLLEKAEEIEKARFKGLAKLKAIGETVFIKFKQFYDEKNAPKGLDVLGLIKNAFVHGNYDALGKFHMNTLFLGMMHFMDEYNYDVERVERCVIHYAMPDGRIVPFCTFNVIPELYRDKVQRQFSYSWEEWKKLHPDWDYMKDKYVRTKEFVEKMKKSELYRKTYIDIVNYFER

SEQ ID NO: 550 - protein, 1455 aa, Pyrococcus abyssi
  Pab Pol-II precursor
MELPKEMEEYFEMLQREIDKAYEIAKKARAQGKDPSLDVEIPQATDMAGRVESLVGPPGVAKRIRELVKEYGKEIAALKIVDEIIEGKFGDLGSREKYAEQAVRTALAILTEGIVSAPIEGIANVKIKRNTWADNSEYLALYYAGPIRSSGGTAQALSVLVGDYVRRKLGLDRFKPSEKHIERMVEEVDLYHRAVTRLQYHPSPEEVRLAMRNIPIEITGEATDDVEVSHRDVPGVETNQLRGGAILVLAEGVLQKAKKLVKYIDKMGIEGWEWLKEFVEAKEKGEPKEEGKEESLAESTLEETKVEVDMGFYYSLYQKFKEEIAPSDKYAKEVIGGRPLFSDPSKPGGFRLRYGRSRASGFATWGINPATMILVDEFLAIGTQLKTERPGKGAVVTPVTTIEGPIVKLKDGSVLRVDDYNLALKVREDVEEILYLGDAVIAFGDFVENNQTLLPANYCEEWWILEFVKALKEIYEVHLEPFTENEEESIEEASDYLEIDPEFLKEMLRDPLRVKPPVELAIHFSEVLGIPLHPYYTLYWNSVEPKDVEKLWRLLKNYAEIEWSNFRGIKFAKKIVISQEKLGDSKRTLELLGLPHTVRDGNVIVDYPWAAALLTPLGNLNWEFMAKPLYATIDIINENNEIKLRDRGISWIGARMGRPEKAKERKMKPPVQVLFPIGLAGGSSRDIKKAAEEGKVAEVEIAFFKCPKCGHVGPEHLCPNCGTRKELLWVCPRCNAEYPESQAEGYNYTCPKCNVKLRPYAKRKIRPSELLNRAMENVKVYGVDKLKGVMGMTSGWKMPEPLEKGLLRAKNDVYVFKDGTIRFDATDAPITHFRPREIGVSVEKLRELGYTHDFEGKPLVSEDQIVELKPQDIILSKEAGRYLLKVAKFVDDLLEKFYGLPRFYNAEKMEDLIGHLVIGLAPHTSAGIVGRIIGFVDALVGYAHPYFHAAKRRNCFPGDTRILVQIDGVPQKITLRELYELFEDERYENMVYVRKKPKREIKVYSIDLETGKVVLTDIEDVIKAPATDHLIRFELEDGRSFETTVDHPVLVYENGRFIEKRAFEVKEGDKVLVSELELVEQSSSSQDNPKNENLGSPEHDQLLEIKNIKYVRANDDFVFSLNAKKYHNVIINENIVTHQCDGDEDAVMLLLDALLNFSRYYLPEKRGGKMDAPLVITTRLDPREVDSEVHNMDIVRYYPLEFYEATYELKSPKELVGVIERVEDRLGKPEMYYGLKFTHDTDDIALGPKMSLYKQLGDMEEKVRRQLEVAKRIRAVDEHGVAEKILNSHLIPDLRGNLRSFTRQEFRCVKCNTKFRRPPLNGKCPVCGGKIVLTVSKGAIEKYLGTAKMLVTEYNVKNYTRQRICLTERDIDSLFENVFPETQLTLIVNPNDICQRLVMARTGEVNKSGLLENLSNGSKKTEKAEKAEKPRKKSDEKPKKKRVISLEEFFSRKSK

SEQ ID NO: 551 - protein, 1437 aa, Pyrococcus abyssi
  Pab RFC-1 precursor
MRDMEEVREVKVLEKPWVEKYRPQKLEEIVGQEHIVKRLKHYVKTGSMPHLLFAGPPGVGKCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNTTAALALARELFGENWRHNFLELNASDERGINVIREKVKEFARTKPIGGASFKIIFLDEADALTQDAQQALRRTMEMFSSNVRFILSCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNCNYSSKIIEPIQSRCAIFRFRPLNDEDIAKRLRYIAENEGLELTEEGLQAILYIAEGDMRRAINILQAAAALDRKITDENVFLVASRARPEDIREMMLLALKGNFLKAREKLREILLKQGLSGEDVLVQMHREVFNLPIDEPMKVYLADKIGEYNFRLVEGANEMIQLEALLAQFTLIGKKK

SEQ ID NO: 552 - protein, 1437 aa, Pyrococcus abyssi; identical to SEQ ID NO: 551
  Pab RFC-2 precursor

SEQ ID NO: 553 - protein, 2122 aa, Pyrococcus abyssi
  Pab RIR1-1 precursor
MPVEKVMKRDGRIVPFDESRIRWAVQRAMWEVGVRDERKLDEVVKNIVKRINELYDGKIPHIENIQDIVELELMRAGLFEVAKAYILYRKKKAEIREEKKRILNKKELDEIDKRFSINALRVLASRYLKRDENGNIIESPRELFERVSILAVIPDLLYDERVFDKDGNYKQDLKRVEYYLENFEKFDGKYSIGKYKLNKYHFERMVNLYRELAEKGKMKVSIDEFLSMLERGEFDKYEKEIEEYFKLMTNQVFMPNTPALINSGRPLGMLSACFVVPIEDDMESIMKAAHDVAMIQKMGGGCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNTGLNFSKLRPEGDIVGTTTGAACFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNSGPVSFMHLIDAVSDVIKQGGVRRGANMGILEIWHPDIEKFIHAKEKNIGTNVLSNFNISVGIWEDFWEALKEGKKYPLINPRTGEVVKEIDPKTLFEELAYMAWAKADPGVIFFDIINRRNVLKEAKGGPIRATNPCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNCGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSIEAAKKRGTFPLYEKTGYPKGELPVEGFYHPEIWNLPWDKLVEEIKKYGVRNAMVTTCPPTGSVSMIADTSSGIEPIFALVYKKSVTVGEFYYVDPVFEAELKRRGLYSEELLKKISDNYGSVQGLEEIPEDMRRVFVTALDIHWLDHLLAQANIQMWLTDSASKTINMINEATVEDVKAAYLIAHFLGCKGVTVYRDGSLSVQVYSVEGEKKRRYKPKPSEYAKKVLLEIVEKEPWIKNFINVDEILNGKRQELNFSLTGLKRETHEVKKVEVKQQNNKIPEEKIKELLGVVYCPVCYEREGKLVELRMESGCATCPVCGWSKCVIS

SEQ ID NO: 554 - protein, 2122 aa, Pyrococcus abyssi; identical to SEQ ID NO: 553
  Pab RIR1-2 precursor

SEQ ID NO: 555 - protein, 2122 aa, Pyrococcus abyssi; identical to SEQ ID NO: 553
  Pab RIR1-3 precursor

SEQ ID NO: 556 - protein, 916 aa, Pyrococcus abyssi
  Pab RtcB (Pab Hyp-2) precursor
MTVPLKRIDKIRWEIPKFDKRMRVPGRVYADDVLLEKMKSDRTLEQAANVAMLPGIYKYSIVMPDGHQGYGFPIGGVAAFDVNEGVISPGGIGYDINCLAPGSKVLTEHGYWLKVEELPEKFKLQGVKVYNLDEGHNDTSNVAFVAEREVETGEMAVRVTTESGRIIEGSEDHPVLTPEGYVYLGNLKEGNLVIVYPFEGVEYEERKGVILDEDAFKDEDPQVLSFLREKGLVPLRWDDPRIGTIARILGFAFGDGYLGEMGGRLTLTFYGKEETLRELKKDLERLGISANLYVRESIETTSGHSEGKSLSIELRVTSRSFALFLEKLGMPRGKKTEKAYRVPGWILEAPLWVKRNFLAGLFAADGSIVEFKGNTPLPINLTQSKSDELAENLVEFLGDVAKLLAEFGIETTLYEVKSKKGVTYRLSIVGEDSIRTFVERINYEYDPEKKVKGLIAAAYLKLKERIVKEAHEAVKDDFPTFEEFAKERGYEGGFVAEKVVKVERVKPEYTKFYDIGVYHEAHNFIANGIVVHNCGVRLIRTNLTEKDVRPRIKQLVDTLFKNVPSGVGSQGRVRLHWTQIDDVLVDGAKWAVDNGYGWEEDLERLEEGGRMEGADPDAVSQRAKQRGAPQLGSLGSGNHFLEVQVVDKIFDPEVAKVYGLFEGQVVVMVHTGSRGLGHQVASDYLRIMERAIRKYRIPWPDRELVSVPFQSEEGQRYFSAMKAAANFAWANRQMITHWVRESFQEVFRQDPEDLGMSIVYDVAHNIGKVEEHEVDGKKVKVIVHRKGATRAFPPGHEAIPKIYRDVGQPVLIPGSMGTASYVLAGTEGAMKETFGSTCHGAGRVLSRKAATRQYRGDRIRQELLNRGIYVRAASMRVVAEEAPGAYKNVDNVVKVVSEAGIAKLVARMRPIGVAKG

SEQ ID NO: 557 - protein, 1017 aa, Pyrococcus abyssi
  Pab VMA precursor
MVAKGRIIRVTGPLVVADGMKGAKMYEVVRVGELGLIGEIIRLEGDKAVIQVYEETAGVRPGEPVIGTGSSLSVELGPGLLTSIYDGIQRPLEVIREKTGDFIARGVTAPALPRDKKWHFIPKVKVGDKVVGGDIIGEVPETSIITHKIMVPPGIEGEIVEIAEEGEYTIEEVIAKVKTPSGEIKELKMYQRWPVRVKRPYKEKLPPEVPLITGQRVIDTFFPQAKGGTAAIPGPFGSGKCVDGDTLVLTKEFGLIKIKDLYKILDGKGKKTVNGNEEWTELERPITLYGYKDGKIVEIKATHVYKGFSAGMIEIRTRTGRKIKVTPIHKLFTGRVTKNGLEIREVMAKDLKKGDRIIVAKKIDGGERVKLNIRVEQKRGKKIRIPDVLDEKLAEFLGYLIADGTLKPRTVAIYNNDESLLRRANELANELFNIEGKIVKGRTVKALLIHSKALVEFFSKLGVPRNKKARTWKVPKELLISEPEVVKAFIKAYIMCDGYYDENKGEIEIVTASEEAAYGFSYLLAKLGIYAIIREKIIGDKVYYRVVISGESNLEKLGIERVGRGYTSYDIVPVEVEELYNALGRPYAELKRAGIEIHNYLSGENMSYEMFRKFAKFVGMEEIAENHLTHVLFDEIVEIRYISEGQEVYDVTTETHNFIGGNMPTLLHNTVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNVDPEWKAMRDKAMELLQKESELQEIVRIVGPDALPERERAILLVARMLREDYLQQDAFDEVDTYCPPEKQVTMMRVLLNFYDKTMEAISRGVPLEEIAKLPVREEIGRMKFEPDVGKIKALIDKTNEQFEELFKKYGA

SEQ ID NO: 558 - protein, 1150 aa, Pyrococcus furiosus
  Pfu KlbA precursor
MGVYEVRKNMEEDKKKKKSWIDEILSSDNLSLESILKKSEEEKPKKVSVESKSLSLGDILSGRVKEEEKKREASPLQSLLGGGPPKLEEILKKEEPKREEKKPKIERGALGLQEILAGTTPRTTSYAGEVRVLDVYGNIRILKVKGEPVPIYEINMPKLSKEEERLVKMVRDRAIVEIQIDPESIPNPEERRKVFLREVRRMVKEMAPTLSEGRVELISELIVQNMIGYGKIDPLVRDDNLEEIMVIGINKPVYVWHRRFNMCKTNIVFTDERELLTIIERIAREVGRRIDQQNPLLDARLPDGSRVNATLPPISLDGPTLTIRKFKKDPLTIIDLIRFGTLNSEVAAFLWLLVDGLGVKPANILVAGGTGSGKTTTLNSLAMFIPPSERVISIEDTAELQLPIEHWVRLETRPPNVEGKGEITMDDLVKNTLRMRPDRIIVGEVRGPEARTMFTAMNTGHDGALYDFSVIQLSNGRFVLIGDLVEELFKKYAEKIKTYKDLEYIELNEEDRFEVVSVSPDLKANKHVVSRVWRRKVREGEKLIRIKTRTGNEIILTRNHPLFAFSNGDVVRKEAEKLKVGDRVAVMMRPPSPPQTKAVVDPAIYVKISDYYLVPNGKGMIKVPNDGIPPEKAQYLLSVNSYPVKLVREVDEKLSYLAGVILGDGYISSNGYYISATFDDEAYMDAFVSVVSDFIPNYVPSIRKNGDYTIVTVGSKIFAEMLSRIFGIPRGRKSMWDIPDVVLSNDDLMRYFIAGLFDADGYVDENGPSIVLVTKSETVARKIWYVLQRLGIISTVSRVKSRGFKEGELFRVIISGVEDLAKFAKFIPLRHSRKRAKLMEILRTKKPYRGRRTYRVPISSDMIAPLRQMLGLTVAELSKLASYYAGEKVSESLIRHIEKGRVKEIRRSTLKGIALALQQIAKDVGNEEAWVRAKRLQLIAEGDVYWDEVVSVEEVDPKELGIEYVYDLTVEDDHNYVANGILVSNCMGTIHANSARETIIRLESPPMSVPRIMIPALDIIIMQVRYHSRKKGTLRRITEIAEVSGIEGESIQLNFLYKYDPAKDELIRTEVPSRFIQTLSYHTGLSIEELKWEIEKRRLILDWMIEKGIRRIDEVGYYIKEFYIDEEELLKKIEREAETIETSKRAKEFI

SEQ ID NO: 559 - protein, 1740 aa, Pyrococcus furiosus
  Pfu RIR1-1 precursor
MAVEKVMKRDGRIVPFDESRIRWAVQRAMWEVGIRDEKKLDEVVKSIVQRINELYDGKIPHIENIQDIVELELMRAGLFEVAKAYILYRKKKAEIREEKKRILNKKELDEIDKRFSINALRVLASRYLKKDENGNIVESPRELFERVAILAVIPDLLYDERVFDKNGNYSQDLKRVEYYLEHFEEFDRKYSIGKYKLNKYHFERMVNLYKELAEQGKMKVSIDEFLAMLEKGEFNEYEKEINEYFRLMTNQIFMPNTPALINSGRPLGMLSACFVVPIEDDMESIMKAAHDVAMIQKMGGGCIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGEDYKFIFDYWLAGFIAGDGCFDKYHSHVKGHEYIYDRLRIYDYRIETFEIINDYLEKTFGRKYSIQKDRNIYYIDIKARNITSHYLKLLEGIDNGIPPQILKEGKNAVLSFIAGLFDAEGHVSNKPGIELGMVNKRLIEDVTHYLNALGIKARIREKLRKDGIDYVLHVEEYSSLLRFYELIGKNLQNEEKREKLEKVLSNHKGGNFGLPLNFNAFKEWASEYGVEFKTNGSQTIAIINDERISLGQWHTRNRVSKAVLVKMLRKLYEATKDEEVKRMLHLIEGLEVVRHITTTNEPRTFYDLTVENYQNYLAGENGMIFVHNTGLNFSKLRPEGDIVGTTTGAASGPVSFMHLIDAVSDVIKQGGVRRGANMGILEIWHPDIEKFIHAKEKNIGTNVLSNFNISVGIWEDFWEALKEGKKYPLINPRTGEVVKEVDPKTLFEELAYMAWAKADPGVIFFDVINRRNVLKKAKGGPIRATNPCVVGDTRILTPEGYLKAEEIFSLAKERGKKEAVAVEGIAEEGEPYAYSVEILLPGEEKVEYETVHGKVLAVADPVAVPAYVWKVGRKKVARVKTKEGYEITATLDHKLMTPEGWKEVGKLKEGDKILLPRFEVEEEFGSESIGEDLAFVLGWFIGDGYLNVNDKRAWFYFNAEKEEEIAVRIRDILVKHFGIKAELHRYGNQIKLGVRGEAYRWLENIVKNNEKRIPEIVYRLKPREIAAFLRGLFSADGYVDKDMAIRLTSKSRELLREVQDLLLLFGILSKIYEKPYESEFHYTTKNGEERIYRSKGYYELVITNYSRKLFAEKIGLEGYKMEKLSLKKTKVDQPIVTVESVEVLGEEIVYDFTVPNYHMYISNGFMSHNCGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSVEAAKKRGTFPLYDKTEYPEGKLPVEGFYHPEIWNLPWDKLVEEIKKYGLRNAMVTTCPPTGSVSMIADTSSGIEPVYALVYKKSVTVGEFYYVDPVFEEELKKRGLYSEELLKKISDNYGSVQGLEEIPEDMQRVFVTALDIHWLDHIIAQASIQMWLTDSASKTINMINEATVEDVKAAYLIARFLGCKGVTVYRDGSLSVQVYSVEGEKKKRRFKPKPSEYAKKILLEIVEKEPWIKNFINVDEILNGKKEQLLFSLRPANESKLKVPGREEEVRPGNIPEEKIRELLGVVYCPVCYEKEGKLVELKMESGCATCPVCGWSKCVIS

SEQ ID NO: 560 - protein, 1740 aa, Pyrococcus furiosus; identical to SEQ ID NO: 559
  Pfu RIR1-2 precursor

SEQ ID NO: 561 - protein, 1013 aa, Pyrococcus furiosus
  Pfu VMA precursor
MPAKGRIIRVTGPLVIADGMKGAKMYEVVRVGELGLIGEIIRLEGDKAVIQVYEETAGLKPGEPVEGTGSSLSVELGPGLLTSIYDGIQRPLEVLREKSGHFIARGISAPALPRDKKWHFTPKVKVGDKVVGGDIIGEVPETSIIVHKIMVPPGIEGEIVEIADEGEYTIEEVIAKVKTPSGEIKELKMYQRWPVRVKRPYKEKLPPEVPLVTGQRVIDTFFPQAKGGTAAIPGPFGSGKCVDGDTLILTKEFGLIKIKDLYEKLDGKGRKTVEGNEEWTELEEPITVYGYKNGKIVEIKATHVYKGASSGMIEIKTRTGRKIKVTPIHKLFTGRVTKDGLVLEEVMAMHIKPGDRIAVVKKIDGGEYVKLDTSSVTKIKVPEVLNEELAEFLGYVIGDGTLKPRTVAIYNNDESLLKRANFLAMKLFGVSGKIVQERTVKALLIHSKYLVDFLKKLGIPGNKKARTWKVPKELLLSPPSVVKAFINAYIACDGYYNKEKGEIEIVTASEEGAYGLTYLLAKLGIYATIRRKTINGREYYRVVISGKANLEKLGVKREARGYTSIDVVPVDVESIYEALGRPYSELKKEGIEIHNYLSGENMSYETFRKFAKVVGLEEIAENHLQHILFDEVVEVNYISEPQEVYDITTETHNFVGGNMPTLLHNTVTQHQLAKWSDAQVVVYIGCGERGNEMTDVLEEFPKLKDPNTGKPLMERTVLIANTSNMPVAAREASIYTGITIAEYFRDMGYDVALMADSTSRWAEALREISGRLEEMPGEEGYPAYLASRLAEFYERAGRVVTLGSDYRVGSVSVIGAVSPPGGDFSEPVVQNTLRVVKVFWALDADLARRRHFPAINWLTSYSLYVDAVQDWWHKNVDPEWRRMRDKAMELLQKEAELQEIVRIVGPDALPERERAILLVARMLREDYLQQDAFDEVDTYCPPQKQVTMMRVLMTFYERTMDAISRGVPLEEIAKLPVREEIGRMKFEPDIEKIRALIDKTNEQFDELLKKYGA

SEQ ID NO: 562 - protein, 1108 aa, Pyrococcus horikoshii OT3
  Pho CDC21-1 precursor
MEREEIIERFLKFFREYAEEGEEPLYMGKIKDLLTITPKRSIVINWMHLNSYDPELAEEVIENPEECILAAEDAIQIILKEDFLREDVPKIHARFHNLPKTLMVKEVGAEHINKLIQVEGVVTRVTEIKPFVSVAVFVCKDCGHEMVVPQKPYEGFVAVKKCEQCGSKNVQLDVEKSKFVNFQMFRIQDRPESLRGGQMPRFIDGILLDDIVDTAMPGDRVIVVGILRVIQEKREKVPTFKKVIEVNHIEPISKELEELEISPEDEQKIRELAKRKDIVSAIVDSIAPAIYGYKEVKKGIALALFGGVSRTLPDGTRLRGDIHVLLVGDPGVAKCVDYDTEVLLGDGRKRKIGEIVEEAIKKAEKEGKLGRVDDGFYAPINLELYALDVRTLKVRKVKADIAWKRTTPEKMLRIRTKRGREIRVTPTHPFFTLEEGRIKTKKAYELKVGEKIATPREEAPEAEIFWDEVVEIEEYKPNNSWVYDLQVPEHHNFIANGIFVHNSQLLRYVANLAPRAIYTSGKSSSAAGLCVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHNTAAVVRDEFTGGWVLEAGALVLADGGYALIDELDKMSDRDRSVIHEALEQQTISLSKAGITATLNARTTVIAAANPKHGRFNRMKRVSEQIDLPPTLLSRFDLIFVLMDEPDEKVDSEIARHILKVRRGESEVVTPKIPHELLRKYIAYARKNIHPVISEEAMEEIEKYYVKMRRSAKKSSGDEIKPIPITARQLEALIRLSEAHARMRLSPIVTREDAREAIKLMEYTLKQIAVDEAGQLDVTILEVGQSARKLSKVERILDIVEKLERTSEKGAKIDDILEEAAKFGIEKSEAREILEKLLEKGQIYMPENGYYKTV

SEQ ID NO: 563 - protein, 1108 aa, Pyrococcus horikoshii OT3; identical to SEQ ID NO: 562
  Pho CDC21-2 precursor

SEQ ID NO: 564 - protein, 1044 aa, Pyrococcus horikoshii OT3
  Pho IF2 precursor
MSYVKRIRQPIIAVLGHVDHGKCLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHNTTLLDKIRKTNVAAKEAGGITQHIGATEVPIDVVKKIAGPLIKLWKAEIRLPGLLFIDTPGHEAFTSLRARGGSLADLAVLVIDVNEGFQPQTIESIEILRRYRTPFVVAANKIDRIRGWVIEEDEPFLMNIKRQDQRAIQELETKLWELIGKFYEFGFQANRFDRVQNFTRELAIVPISAKYGIGIAELLVLIAGLSQKYLEEKLKIEVEGPARGTILEVREEPGLGHTIDVIIYDGTLHKDDTIVVGGKDKAIVTKVRALLKPKPLDEIRDPRFRFDYVDEVTAAAGVKIAAPGLEEALAGSPVIAAPTPEDVERAKEEIMRQIESVVISTDKVGVIVKADTLGSLEALSKELQEKEIPIRKADVGNISKTDVMEALSVKEENPKYGVILGFNVKVNEDAKEVAKAKEVPIFVGNIIYKLIEDYEAWIKEEEEKRKRELLAKVTFPGVIKLYPDERYVFRRSNPAIVGIEVLEGRIKPGVTLIKQNGQKVGTIRSIKSRDEFLQEARKGQAVAIAIEGAIVGRHIHPGETLYVDLSRDDAIILLKHLRDVLEDTDIKALKMIAQVKAKEDPFWRAV

SEQ ID NO: 565 - protein, 1136 aa, Pyrococcus horikoshii OT3
  Pho KlbA precursor
MSEKEEKKRARSWIDEILSSDNLTLEAILKKSSGEGKSTPEKPKTESLSRGNILPTPSPQKQEAGEGLPLAFLEKTGALRLEDILKKPEEERKEEEVPIRIQEILTPPTSKKYTGQILKVLDVYGNVRIIRVKGEAVPIYELSIPELSKDEEKLLKLVRDRAIVEIQIDPESIPNLEERRRIFLREVRKMVKEMAPTLSEGRVELLSELIVQNMIGYGKLDPLVRDDNLEEIMVIGTNRPVYVWHRRFGMCKTNITFTSEREILTIIERIAREVGRRIDQQNPLLDARLPDGSRVNATLPPISLDGPTITIRKFKKDPLTIIDLIKFRTLNSEVAAFLWLLVDGLGVKPANILVAGGTGSGKTTTLNSLAMFIPPSERVISIEDTAELQLPIEHWVRLETRPPNVEGKGEITMDDLVKNTLRMRPDRIIVGEVRGPEARTMFTAMNTGHDGALYDFSIIQLSNGRFVLIGDLVEELFKKYSDKIERYKDLEYIELNDEDRFEVVSVGPDLKANKHIVSRVWRRRVREGEKLIRIKTRTGNEVILTRSHPLFAFSNGDVVRKEAGNLKVGDRVAVMMNPPKPPQTKAVVDLSIYAKISDYYLVPNGKGMIKVPNKGLPPEKAQYLVSVNSHPVKLVREVDEKLSYLAGVILGDGYISSNGYYISATFDDEDYMEAFVSVISDFIPNYIPNVKENGKYMVVTVGSKIFAEMLSRIFGIPKGRKLEWDVPDIVLSNDDLMRYFIAGLFDADGYVDENSIILVTKSENVARKIWYALQRLGIISTVSRVKNKGFKEGEIFRVIISGVDDLAKFARSIPLHHSRKRAKLMEVLKTKKTHRGRRAYRVPISAEMIAPLRQMLGLTVSELSKLASHYAGEKVSESLIRHVEKGRVKEIRRSTLRGIALALQQVAKDVGDEEAWVKARRLQLIAEGDVYWDEVVSVEEVDPKELGIEYVYDLTVEDDHNYVANGILVSNCMGTIHSNSARETIIRLESPPMNVPRIMIPALDIIIMQVRYHTRKKGTIRRMTEIAEVSGIEGESIQLNFLYKYDPAKDEIVRTEVPSRFLNILSYHTGMGMDELYYEIEKRKLVLDWMIEKGIRRIDEVGAQIREFYIDEEEFFKKLEREATTIEMSKRVKEFI

SEQ ID NO: 566 - protein, 1352 aa, Pyrococcus horikoshii OT3
  Pho LHR precursor
MMGNVRWAKRKYTDDEIYSILDPLVREWFKRKFNSFTPPQRYAIVEIHKGENVLISSPTGSGKTLSAFLAIISELISLGRKGKLEDKIYCVYISPLRALNNDIRRNLEEPLREIKELAQELGEEIPEIRIAVRTSDTSSYEKSKMVKKPPHILITTPESLAIALNAPKFRERLRDVRWVIVDEVHALAENKRGSHLALTLERLRELVGRDFVRIGLSATIHPLEEVAKFVFGFNDDGTPRSGLIVDVSFAKQTEIKVESVVEDLIYTDAETLSNALYNRLAELIRKHKTTLIFTNTRSGAERVAFNLKKRFPEFKGLIETHHSSLSREVRLDVEEKLKRGELRAVVCVSGDSKVLTEKGPVEIRHLNSGMIVGINGFKSRFVKFQELHQVKYQEYGVKIRTQLGFEVKCTREHRFLTIDKNGELRWVEAWRLKEGDYVGIIRKLPSPNSKVLILDFLPESTYLWLNKEFLKKLKVSIKEKFGSIKNYAKERGFNSSYLVKQLNGLSPFRWGRLRVILNDVSIEISRDDIERITSRRGKYSLPPELTPGIARLLGFWMASGSLNRNTLIFYSQDKKILERYEDLCKREFRVKGRIKAQDKGTYILEIPSSLLSFVFKNLARPKLEVPPIIYILPEKHKEEFLAGYFDGNGFIKIENGRIHSLGFFAFNRKFAEGIRDILLQLGILSSINEQTFEVSIIEGEKFLKIVNSWRSNYYKEWEDVIPNLEKRLKEIEEKLGYPGTYNRREIRRSELKAIIKLYEKVARERGLNDVLKELSYLKELSEGDIFFDRITSIEPVYLDVAYGIINSETGNYVVNGFVSKNSSTSLELGIDIGTIDLVVLVGSPKSVNRALQRIGRAGHRLHEVSRGIILALDRDDLVEVTVLAHNARNRKLDRIKIPKNPLDVLVQHILGMALEKVWEIEEAYRVVRRAYPYHELPFSDFMNVLKYLAGEYSGLEEKRVYAKIWLENGKFGRRGKMTRAIYYMNTGTIPDEAKIDVFTLDKKYIGTVEEEFAERLMPGDIFVLAGRTYEFVKSRGNKIYVIPREGAKPTIPSWFSEMLPLSFDLAIDIQRFRGEVKKLLTSKRAESLLMKKYGIDNVTAKAIISYFREQAKYSIIPDDETVLVEIVREGNVTKYFFHTLIGRRANDALSRAFAYMISKKKKCNVGIAITDNGFMLKVPVDKELKEGEILELFYVENLREILKRALDNTELLKRRFRHVANRGLLILRRYMGREKSLSRQQMNAQTLLNFLKKNHPNFPLLKEVYREIMEDKMDIENAELFLKWIKEGKIKVTVREHPYPSPFAFNLEVIGASDVVLMEDRRELIKELHKKIMAIIKGVPSPTAPRSPITGV

SEQ ID NO: 567 - protein, 1127 aa, Pyrococcus horikoshii OT3
  Pho Lon precursor
MLSGESEMDEERMDLGIEFETTEEIPVPERLIDQVIGQDHAVEVIKTAAKQRRHVLLIGEPGTGKSMLGQAMAELLPTEELEDILVFPNPEDENMPRIKTVPAGQGRKIVEEYRRKAKEQEGVRFYLLFFVFFIVAMAVFLSHGDPNTLLLGVFVILVALMVTANMRFKTQAMVPKLLVDNSGRKRAPFVDATGAHAGALLGDVRHDPFQCFSGEEVIIVEKGKDRKVVKLREFVEDALKEPSGEGMDGDIKVTYKDLRGEDVRILTKDGFVKLLYVNKREGKQKLRKIVNLDKDYWLAVTPDHKVFTSEGLKEAGEITEKDEIIRVPLVILDGPKIASTYGEDGKFDDYIRWKKYYEKTGNGYKRAAKELNIKESTLRWWTQGAKPNSLKMIEELEKLNLLPLTSEDSRLEKVAIILGALFSDGNIDRNFNTLSFISSERKAIERFVETLKELFGEFNYEIRDNHESLGKSILFRTWDRRIIRFFVALGAPVGNKTKVKLELPWWIKLKPSLFLAFMDGLYSGDGSVPRFARYEEGIKFNGTFEIAQLTDDVEKKLPFFEEIAWYLSFFGIKAKVRVDKTGDKYKVRLIFSQSIDNVLNFLEFIPISLSPAKREKFLREVESYLAAVPESSLAGRIEELREHFNRIKKGERRSFIETWEVVNVTYNVTTETGNLLANGLFVKNSGGLGTPAHLRVEPGMIHRAHKGVLFIDEIATLSLKMQQSLLTAMQEKKFPITGQSELSSGAMVRTEPVPCDFILVAAGNLDTIEKMHPALRSRIRGYGYEVYMRTTMPDTPENRRKLVQFVAQEVKKDGRIPHFTRDAVEEIVREAQRRAGRKGHLTLRLRDLGGVVRAAGDIAVRKGKKYVTREDVLEALKLAKPLEKQLADWYIERKKEYQVIRVEGGEIGRVNGLAIIGEQSGIVLPIEAIVAPAASKEEGKIIVTGKLGEIAKEAVLNVSAIIKRYKGEDISKYDIHVQFLQTYEGVEGDSASISVATAVISALEEIPVRQDVAMTGSLSVRGEVLPVGGVTPKIEAAIEAGIKTVIIPKSNEKDVFLSPDKRKKIKIIPVERIDEVLEVALVESEKKRELIKRVRESLPLWMEETPSGETLHEHKGGATLPLEESKA

SEQ ID NO: 568 - protein, 1235 aa, Pyrococcus horikoshii OT3
  Pho Pol I precursor
MILDADYITEDGKPIIRIFKKENGEFKVEYDRNFRPYIYALLRDDSAIDEIKKITAQRHGKVVRIVETEKIQRKFLGRPIEVWKLYLEHPQDVPAIRDKIREHPAVVDIFEYDIPFAKRYLIDKGLTPMEGNEKLTFLAVDIETLYHEGEEFGKGPVIMISYADEEGAKVITWKKIDLPYVEVVSSEREMIKRLIRVIKEKDPDVIITYNGDNFDFPYLLKRAEKLGIKLLLGRDNSEPKMQKMGDSLAVEIKGRIHFDLFPVIRRTINLPTYTLEAVYEAIFGKPKEKVYADEIAKAWETGEGLERVAKYSMEDAKVTYELGREFFPMEAQLARLVGQPVWDVSRSSTGNLVEWFLLRKAYERNELAPNKPDEKEYERRLRESYEGGYVKEPEKGLWEGIVSLDFRSLYPSIIITHNVSPDTLNREGCEEYDVAPKVGHRFCKDFPGFIPSLLGQLLEERQKIKKRMKESKDPVEKKLLDYRQRAIKILANSILPDEWLPIVENEKVRFVKIGDFIDREIEENAERVKRDGETEILEVKDLKALSFNRETKKSELKKVKALIRHRYSGKVYSIKLKSGRRIKITSGHSLFSVKNGKLVKVRGDELKPGDLVVVPGRLKLPESKQVLNLVELLLKLPEEETSNIVMMIPVKGRKNFFKGMLKTLYWIFGEGERPRTAGRYLKHLERLGYVKLKRRGCEVLDWESLKRYRKLYETLIKNLKYNGNSRAYMVEFNSLRDVVSLMPIEELKEWIIGEPRGPKIGTFIDVDDSFAKLLGYYISSGDVEKDRVKFHSKDQNVLEDIAKLAEKLFGKVRRGRGYIEVSGKISHAIFRVLAEGKRIPEFIFTSPMDIKVAFLKGLNGNAEELTFSTKSELLVNQLILLLNSIGVSDIKIEHEKGVYRVYINKKESSNGDIVLDSVESIEVEKYEGYVYDLSVEDNENFLVGFGLLYAHNSYYGYYGYAKARWYCKECAESVTAWGRQYIDLVRRELEARGFKVLYIDTDGLYATIPGVKDWEEVKRRALEFVDYINSKLPGVLELEYEGFYARGFFVTKKKYALIDEEGKIVTRGLEIVRRDWSEIAKETQARVLEAILKHGNVEEAVKIVKDVTEKLTNYEVPPEKLVIYEQITRPINEYKAIGPHVAVAKRLMARGIKVKPGMVIGYIVLRGDGPISKRAISIEEFDPRKHKYDAEYYIENQVLPAVERILKAFGYKREDLRWQKTKQVGLGAWIKVKKS

SEQ ID NO: 569 - protein, 1434 aa, Pyrococcus horikoshii OT3
  Pho Pol-II precursor
MVLMELPKEMEEYFSMLQREIDKAYEIAKKARAQGKDPSLDVEIPQASDMAGRVESLVGPPGVAERIRELVKEYGKEIAALKIVDEIIDGKFGDLGSKEKYAEQAVRTALAILTEGVVSAPIEGIASVKIKRNTWSDNSEYLALYYAGPIRSSGGTAQALSVLVGDYVRRKLGLDRFKPSEKHIERMVEEVDLYHRTVSRLQYHPSPEEVRLAMRNIPIEITGEATDEVEVSHRDIPGVETNQLRGGAILVLAEGVLQKAKKLVKYIDKMGIEGWEWLKEFVEAKEKGEEIEEEGSAESTVEETKVEVDMGFYYSLYQKFKSEIAPNDKYAKEIIGGRPLFSDPSRNGGFRLRYGRSRVSGFATWGINPATMILVDEFLAIGTQLKTERPGKGAVVTPVTTIEGPIVKLKDGSVVKVDDYKLALKIRDEVEEILYLGDAVIAFGDFVENNQTLLPANYCEEWWILEFTKALNEIYEVELKPFEVNSSEDLEEAADYLEVDIEFLKELLKDPLRTKPPVELAIHFSEILGIPLHPYYTLYWNSVKPEQVEKLWRVLKEHAHIDWDNFRGIKFARRIVIPLEKLRDSKRALELLGLPHKVEGKNVIVDYPWAAALLTPLGNLEWEFRAKPLHTTIDIINENNEIKLRDRGISWIGARMGRPEKAKERKMKPPVQVLFPIGLAGGSSRDIKKAAEEGKVAEVEIALFKCPKCGHVGPEHICPNCGTRKELIWVCPRCNAEYPESQASGYNYTCPKCNVKLKPYAKRKIKPSELLKRAMDNVKVYGIDKLKGVMGMTSGWKMPEPLEKGLLRAKNDVYVFKDGTIRFDATDAPITHFRPREIGVSVEKLRELGYTHDFEGNPLVSEDQIVELKPQDIILSKEAGKYLLKVAKFVDDLLEKFYGLPRFYNAEKMEDLIGHLVIGLAPHTSAGIVGRIIGFVDALVGYAHPYFHAAKRRNCFPGDTRILVQINGTPQRVTLKELYELFDEEHYESMVYVRKKPKVDIKVYSFNPEEGKVVLTDIEEVIKAPATDHLIRFELELGSSFETTVDHPVLVYENGKFVEKRAFEVREGNIIIIIDESTLEPLKVAVKKIEFIEPPEDFVFSLNAKKYHTVIINENIVTHQCDGDEDAVMLLLDALLNFSRYYLPEKRGGKMDAPLVITTRLDPREVDSEVHNMDIVRYYPLEFYEATYELKSPKELVGVIERVEDRLGKPEMYYGLKFTHDTDDIALGPKMSLYKQLGDMEEKVKRQLDVARRIRAVDEHKVAETILNSHLIPDLRGNLRSFTRQEFRCVKCNTKFRRPPLDGKCPICGGKIVLTVSKGAIEKYLGTAKMLVTEYKVKNYTRQRICLTERDIDSLFETVFPETQLTLLVNPNDICQRIIMERTGGSKKSGLLENFANGYNKGKKEEMPKKQRKKEQEKSKKRKVISLDDFFSRK

SEQ ID NO: 570 - protein, 1624 aa, Pyrococcus horikoshii OT3
  Pho r-Gyr precursor
MKAIYRGMCPNCRGAITDERLSNKNPCEGCLSEPILSEDYNELIVAVRNALKLRGTLKDWEELYRLNKEVSEIEELFEKSTGFKFWSAQRTWVKRIIRGKSFSIIAPTGMGKSTFGAFISIYFATKGKKSYIVVPTTPLVIQTVKKIESMLEKANVSVRLVYYHGNLRKKEKEEALEKIRNGDFDILITSSQFLATRFKELLKDKKFDLIFVDDVDAFLKASKNIDRSLIMLGFSEEIIGRAWEVIKLKKQLAKLLQNEKKNEEEIEKLNKEIEKIEDEIEEYKRRNKIGILIVASATGSAKGDRIKLYRELLGFEVGSGRSVLRNIVDTYLLPEKPIEEHVVELLRKLGKGGLIFVPIDKGIEYAEELTDYLKSQGFKVELVSAKNKKGLELFEKGEIDYLVGVATYYGTLVRGLDLPHLIRFAIFTGVPKFRFSMDLEQPTIYRVLGLMSEILEFLPEEKKSEGEKLYARLRRLIRNIPQYELMKIEEALAEGLELEGFHNHVLEVFKQSVEFLREVLKDEEVIKKIAENPFLSLKEIEGKLYIEIPDVRTYIQASGRTSRLFAGGITKGLSVIIVDDQKVFNGLIRQMRWRFVEFDIKKFEEVNLKEVLKEIDRDREKVKLVIEGKISEQVKDLVKSALMIVESPNKARTIASFFGQPSKRKIGDLTAYEVSIGDKMLTILASGGHMFDLVTNEGYHGVLILKNNGKPYFVPVYDTIKRCRDCGHQFVDWEQKGVCPRCGSRNVHDALENVKAMRELALEVDEILIGTDPDTEGEKIAWDIRNVLAPYAPNIKRIEFHEVTRPAILRAIREARDINEDRVNAQLVRRIEDRWIGFELSQKLWEVFENRNLSAGRVQTPVLGWIVQRYKEFTESETDFLGIILENGINVTIENAKGEVREVEVKDVIIEEKDVNPLPPYTTDTMLQDASRFLGFSATKTMQLAQDLFEAGLCVTPDTLVSLSDGRIIEIREAVENSEESLLGINGLKPKEAKALKFWEIDWDGPIKVIKLKNGHEIKATPDHGLLVMRDGKIGWVSAKNIREGDYVAFIYNLGHRGGKKYTLPQLLKELGISEYENSSSQELNNREQEMDSKQISIELDERFWYIFGVILGKGTLKGDKVVIFQKDVKPVIEEALPFVRIFESADHIGFSHLILAEVFRRLGVGEGKLHSLVFGLREEYINAMIAGYFDASGTFLRRAVLTSKRGDILRMLSVYLYQIGIVNNLRRDEHAGVWELIISDLEKFREKIYPYLRIKKSQFDKVYSISKNEGDFLPVASIFRKLKFRDGFKNRILDEEIPRDEVAKVLEYAEDSPEKEFLNSLVEARVTWVRVEKIEERHYTGKLYDFTTTTENFISNGIVSHNCTYHRTDSIHVSNTGIEVAKEYITQEIGEEYFTPRKWGEEGAHEAIRPTRPIDTGRLIQLIRDGIITIPKNLTRDHFRLYDLIFRRFMASQMKPAKILYEKAIISTPFKDVEVEGYIDVLYDGWSKIKSLPLRQIPKLEKGQRLRVKEVKQWRAPKVSLYTQGDVIALMKERGIGRPSTYAKIVQTLLQRGYVIETKGKKKLVPTEKGIKVYQYLITKYKDLVSEERTRQLEKIMDMVEEAKADYQDVLNELYEEIKRYVR

SEQ ID NO: 571 - protein, 529 aa, Pyrococcus horikoshii OT3
  Pho RadA precursor
MMIMVKKGSDPEVVEIDEIEGLGLELEEESTTSKKKKKEKEIKSIEDLPGVGPATAEKLREAGFDTLEAIAVASPIELKEVAGISEGAALKIIQAARKAANLGTFMRADEYLKKRESIGRISTGSKSLDKLLGGGIETQAITEVFGEFGSGKCFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHNTQLAHTLAVMVQLPPEEGGLNGSVIWIDTENTFRPERIREIAKNRGLDPDEVLKHIYVARAFNSNHQMLLVQQAEDKIKELLNTDKPVKLLIVDSLTSHFRSEYIGRGALAERQQKLAKHLADLHRLANLYEIAVFVTNQVQARPDAFFGDPTRPIGGHILAHSATLRVYLRKGKGGKRVARLIDAPHLPEGEAVFRITEKGIED

SEQ ID NO: 572 - protein, 855 aa, Pyrococcus horikoshii OT3
  Pho RFC precursor
MHNMEEVREVKVLEKPWVEKYRPQRLDEIVGQEHIVKRLKHYVKTGSMPHLLFAGPPGVGKCLTGDTKVIANGQLFELRELVEKISGGKFGPTPVKGLKVIGIDEDGKLREFEVQYVYKDKTERLIRIRTRLGRELKVTPYHPLLVNRRNGEIKWVKAEELKPGDKLAVPRFLPIVTGEDPLAEWLGYFLGGGYADSKENLIMFTNEDPLLRQRFMELTEKLFSDARIREITHENGTSKVYVNSKKALKLVNSLGNAHIPKECWRGIRSFLRAYFDCNGGVKGNAIVLATASKEMSQEIAYALAGFGIISRIQEYRVIISGSDNVKKFLNEIGFINRNKLEKALKLVKKDDPGHDGLEINYELISYVKDRLRLSFFNDKRSWSYREAKEISWELMKEIYYRLDELEKLKESLSRGILIDWNEVAKRIEEVAEETGIRADELLEYIEGKRKLSFKDYIKIAKVLGIDVEHTIEAMRVFARKYSSYAEIGRRLGTWNSSVKTILESNAVNVEILERIRKIELELIEEILSDEKLKEGIAYLIFLSQNELYWDEITKVEELRGEFIIYDLHVPGYHNFIAGNMPTVVHNTTAALALSRELFGENWRHNFLELNASDERGINVIREKVKEFARTKPIGGASFKIIFLDEADALTQDAQQALRRTMEMFSSNVRFILSCNYSSKIIEPIQSRCAIFRFRPLRDEDIAKRLRYIAENEGLELTEEGLQAILYIAEGDMRRAINILQAAAALDKKITDENVFMVASRARPEDIREMMLLALKGNFLKAREKLREILLKQGLSGEDVLIQMHKEVFNLPIDEPTKVYLADKIGEYNFRLVEGANEMIQLEALLAQFTLVGKKK

SEQ ID NO: 573 - protein, 1291 aa, Pyrococcus horikoshii OT3
  Pho RIR1 precursor
MKCRGVIMVVEKVMKRDGRIVPFDESRIRWAVQRAMWEVGVRDEKKLDEVVKAIVQRINELYDGKIPHIENIQDIVELELMRAGLFEVAKAYILYRKKKAEIREEKKRILNKKELDEIDKRFSINALRVLASRYLKRDENGNIIESPRELFERVAILAVIPDLLYDERVFDKDGNYSQDLKRVEYYLEHFEEFDGKYSIGKYKLNKYHFERMVNLYKELAEKGKMKVSIDEFLGMLERGEFNKYEKEIDEYFRLMTNQIFMPNTPALINSGRPLGMLSACFVVPIEDDMESIMKAAHDVALIQKAGGGTGINFSKLRPEGDIVGTTTGAASGPVSFMHLIDAVSDVIKQGGVRRGANMGILEIWHPDIEKFIHAKEKNIGTNVLSNFNISVGIWEDFLEALKEGKKYPLINPRTGEVVREVDPKSLFEELAYMAWAKADPGVIFFDIINRRNVLKEAKGGPIRATNPCVVGDTRILTPEGYLKIEDLFRMAKERNNGEKVVAVEGIAEGGEEFAYPVAILLPNEEEKEVIYETVHGKQLAIADPIEVKAYVWKVGKKKVARIKTKEGYEIIATLDHKIMTKDGWKAVEDLKEGDLIVLPRFEVEDNFGSESIGEDLAFVLGWLIGDGYINTDDKRVWFYFNAEKEEEIAQKISEILKKRFNSKAEPHRYGSEIKLGVRGEAYKFFEKIVKTNDKRVPEIVYHLKPNEIRAFLRGLFTADGYVDNDGAIRLTSKSRELLRDVQDLLLLFGIISKIYERPYKGTFEYTTKEGEKKVYTAQGYYELVIANYSRKLFAEKIGFEGEKQKKIKLNKTKIDEPYARVESVEIIGEEIVYDLTVPGIHSYISNGFISHNCGEEPLYEYESCNLASINLAKFVKYDENGKPYFDWDEYAYVIQKVTKYLDNAIDVNKFPLPEIDHNTKLTRRIGVGMMGLADALFKLGIPYNSEEGFKFMRKVTEYLTFYAYKYSVEAAKRRGTFPLYEKTEYPKGKLPVEGFYHPEIWNLPWDKLVEEIKKYGLRNAMVTTCPPTGSVSMIADTSSGIEPIYALVYKKSVTVGEFYYVDPVFEAELKKRGLYSEELLKKISDNYGSIQGLEEIPEDMKRVFVTALDIHWLDHLLAQASIQMWLTDSASKTINMINEATVEDVKAAYLIAHFLGCKGVTVYRDGSLSVQVYSVEGEKKKRKYKPKPSEYAKKVFLEIVEKEPWIKNFINVDEILNGKRESNLTFSLSIKKEHQEKPQENKGIPEEKIKELLGVVYCPVCYEREGKLVELRMESGCATCPVCGWSKCVIS

SEQ ID NO: 574 - protein, 964 aa, Pyrococcus horikoshii OT3
  Pho VMA precursor
MVAKGRIIRVTGPLVVADGMKGAKMYEVVRVGELGLIGEIIRLEGDKAVIQVYEETAGVRPGEPVVGTGASLSVELGPGLLTSIYDGIQRPLEVIREKTGDFIARGVTAPALPRDKKWHFIPKAKVGDKVVGGDIIGEVPETSIIVHKIMVPPGIEGEIVEIAEEGDYTIEEVIAKVKTPSGEIKELKMYQRWPVRVKRPYKEKLPPEVPLITGQRVIDTFFPQAKGGTAAIPGPFGSGKCVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHNTVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNIDPEWKAMRDKAMALLQKESELQEIVRIVGPDALPERERAILLVARMLREDYLQQDAFDEVDTYCPPEKQVTMMRVLLNFYDKTMEAINRGVPLEEIAKLPVREEIGRMKFERDVSKIRSLIDKTNEQFEELFKKYGA

SEQ ID NO: 575 - protein, 1521 aa, Pelodictyon luteolum DSM 273
  Plut RIR1 precursor
MKISRLFTSPGENVYDRFEYTQKSSVLRNTDGSKVFEMNELEVPKHWSQMAADILAQKYFRKTGVPQVDGDGNPLLDEEGRPVTGSEHSIRQVVHRLAGCWRQWGEKHGYFDSPEDAEAFYDEVAYMLIAQQGAPNSPQWFNTGLNFAYGITGPAQGHYHVDPATKKVVESEDAYTRPQAHACFIQSVNDDLVNEGGIFDLAVREARVFKFGSGSGTNYSNLRSSGEKLSGGGSSSGLMSFLKIFDSAAGAIKSGGTTRRAAKMVIIDIDHPDVEKFIEWKAREEDKVASLVAGSRICSRFLQAIVEEAILNGADRLENPKLQRLIENALHRAVPMSYIIRVLALVEQGYTTLDFEEYDTHYESEAYQTVGGQNSNNTVRVTNAFMKAVENNELWMLKERTTGKTARAVNARELWEKILLSAWKCADPGLQFDTTINEWHTCPAAGRINASNPCVTAETLVATDRGLERIGELVGQSRGIRGIEGKLHWVEKIFPTGTKEVYELRTKAGYRLKLTGDHPVYTENRGDVKACELSKDDVVRLVGAEFGKESTGSVDVAQLIGLLVGDGCITRNAELTASGEQRRVAFLAMDKAEAEITGWANTLINDLRPELGEHNKQGSLTQTLTSSRVAVGSPRILNLLENYAVLDGGSEKKMFSDAVFRLQQAEQAALLRGLFTADGTVANYGVKSRYVALDSTSLDLLLQVQLLLLNFGIKAKIYENRRAGDLVSMLPDGKGGMREYPVQEMHSLRISRSSRVLFQESIGFMEESRKAEALARLNMTVDTYRDPLVDRVASLRSIGRQPVFDLTEPENHHFIANGIGVHNCSEYMFLDNTACNLASLNLIHFVDEESGHVKINELRHAAALWTVVLEISVLMAHFPSPDIARLSYEYRTLGLGFANLGTVLMVLGIPYDSPKALALAGAISAIITGQAYVTSAEISRDLGPFDGYQANSKEMLRVIRNHRRAARNESEEEYEELSVKPRGIDSEYCPKELFEAAGSVWDEALQKGKKYGFRNAQVSVIAPTGTIGLVMDCDTTGIEPEFAIVKFKKLAGGGYFKIVNQSVHKALKRLGYAAQEIEEIEKYCKGSGSLEGCPSINSQWLMNRGFTEEKIALLESNLAAVFDIRFAFNKWILGEEFCQSLGFTEAQLNDPGFDMLQALGASAEDAEAANDFICGTMTIEGAPHLKLEHLPVFDCASRCGQKGLRFINHMAHVRMMSSVQPFISGAISKTVNMPATATTAEIGEVYLSGWQHMVKAITVYRDGSKLSQPLNISSYQDLDEVIMLGNEEDLDETKGPREVQERIIERVYHRSERRLLPKRRKGFIREAYVGGHKVFLRTGEYEDGSLGEVFIDMYKEGASFKGLLNCFAVLASKALQYGMPLEELVDSFTFTRFEPAGAVQGHNAIKNSTSILDYVFRSIGYDYLGRKDFVHVKAVDEVPEHGADAKNSNGQTSPVAALEAEAVPAAHHAGSEYTNTLKSQVMQAKVQGYTGEQCENCGSMRVKQNGTCKVCEDCGMTTGCS

SEQ ID NO: 576 - protein, 1184 aa, Polaromonas naphthalenivorans CJ2
  Pna RIR1 precursor
MKREHFGRPQDLTATQPISHDVLKEKYLKPGESGVEDVYRRVARALASVELPAEREKHEALFLENLHAGAIGAGRIMSAAGTAIQATLINCFVQPVGDCIQGVDDGGYPGIYEALREAAETMRRGGGVGYDFSRIRPRGAEVKATASMASGPCSYINVFDQSCSTVESAGARRGAQMGVLRIDHPDVHEFITAKRTPGRWNNFNVSVGMSDGFMQALNDDQPWELVHKAKPGAALMAKGAFQRADGLWVYQTVAAREMWDTVMRSAYDFAEPGILFLDNINTDNNLRYCEAIAATNPCVTADTRLATQHGLVPIGWLQANGGALDCTVDRRALGEDRRGTVTRAAVPAFLSAGQAEVFKVTTAEGYQIKATAWHEFYTARGKLKLSELKAGDELWVQSGKGQFGAQGSGALGLLIGLITGDGHFTNRGKDEQAAVISLWGEERQLADDIAGSVNALIAGTSLAPRDYLVKPVAVAERNMVFIRSTMLVRVLDGYGFNGETKLEVPEVVWRGSEACMRGYLQGLFQTDGTVNVSSNSQSCSVRLSSSHRPLLQDVQVLLANFGVFSRIHERREAGPRSLPDGQGGQRDYLCQTQHELIVDGESREAFMREIGFLLPAKREKYDAWVADKALVKTQRFAATITAIEPAGVEPVYDTTQPDGNTVIFNGLVTGQCGEQPLPPYGCCDLGPIILTRFVRHPFGFGGEPEFDFEAFEASVATQVRALDNVLEVTFWPLPQQQTESSAKRRIGVGFTGLGNALAMLRLRYDAPEGRDMAARIAVRMRDAAYAASSELAKEKGAFPKFDANGYLATGTFASRLPAALQQAIRAHGIRNSHLLSIAPTGTVSLAFADNASNGIEPAFSWMYKRKKRESDGSTTEYAVEDHAWRLYRELGGDVNKLPGYFVSALDMSATSHIAMMQAVQPFIDTAISKTVNVPADYPYGDFKSLYHQAWRAGLKGLATYRPNAILGAVLETHASPDATPAAAAPAPMDPMRTVIESRPKGALSAVAEKVEYWTQEGHKTLYIVVSFLPVPSASGSGTVERAIEFFMPVGQSGESQQWITSSMRMLSLAARGGFLERALSDMRKVAWDRGPVRLGTYEKADGTRVPLWHDSEVAAIAYAVQNIIARRAAQSALSLAPAEPVQVASSLAPPVMAGKKCSECGAHAVIRKDGCDYCTQCGHLGTCG

SEQ ID NO: 577 - protein, 1189 aa, Polaromonas species JS666
  Posp-JS666 RIR1 precursor
MKREHFGQPHDVTATQPISHDVLKEKYLKPGENGVEDLYRRVARALASVEPEAARAEHEALFLENLHAGAIGAGRIMSAAGTSIQATLINCFVQPVGDCIQGMDDGGYPGIYEALREAAETMRRGGGVGYDFSRIRPRGAEVKATASMASGPCSYINVFDQSCSTVESAGARRGAQMGVLRIDHPDVFEFITAKRTPGRWNNFNVSVGVSDAFMQALGDDQPWELVHRAKPGARLIAQGAFQRADGLWVYQTLAASELWDTVMRSAYDFAEPGILFLDHINQDNNLRYCESIEATNPCVTADTWVMTTAGPAQVSELTGRSFSAVVDGKAYAVTSDGFFRTGHKPVLALRTREGPALRLTADHRVRRVARRTRYTLEAEWTEAGQLQPGDEILLHDHRALGGWEGAGTHAEGYLLGLLIGDGTLKSDKAVISVWAPELKVAGGGAVAYAQTGAGGIVQAAEAAAATLSHRVDFRGFQRSISGRGEARMASGAVRHLAHEMGMRPGHKTITTAMEKASSVFTEGLLRGLFDADGSVQGSQEKGVSLRLSQSDLSLLQTAQRMLLRLGIASTIYPNRRLAQARPLPDGRGGLRVYETASQHELVISADNLRIYAERIGFADTDKADRLDQALGSYNRSLNRERFTVTVESLTEEGSEDVFDVTVADIHAFDANGLYVHNCGEQPLPPYGCCDLGPIILTRFVRNPFGFNGVPDFDFDAFGKSVTTQVRALDNVLDLTFWPLPQQQAESAAKRRIGVGFTGLGNALVMLCLRYDAPEGREMAARIAVCMRDAAYAASVALAKEKGAFLKFDAEGYLAPGTFANRLPAGLQQAIRAHGIRNSHLLSIAPTGTVSLAFADNASNGIEPSFSWMYRRRKRESDGSTTDYAVEDHAWRLYRELGGDVDRLPGYFVSALEMSAASHIAMMEAVQPFVDTAISKTVNVPVDYAYDDFKGLYQQAWRARLKGLATYRPNAILGAVLETHASAAATPPAAPTPVDPMRTVIESRPKGALSAVAEKVEYWTQEGHKTLYIVVSFLPVPAASGEGTVERAIEFFMPVGQSGESQQWITSSMRMLSLAARGGFLERALSDMRKVAWDRGPVRLGTYEKADGTRVPLWHDSEVAAIAYAVQNIIARRARQPAAGTTPVVEPQVDPALAPPVMAGKKCSECGAHAVIRKDGCDYCTQCGHLGVCG

SEQ ID NO: 578 - protein, 940 aa, Pseudomonas aeruginosa phage phiEL
  PP-PhiEL Helicase precursor
MLGLFSVKIKQTGDYVHITGVSYYDLAKDIEKFYSTSLLTKHQIRRESWDTIKVHNFFLVELHHIVGELLKIRNLRTRRRALSELKELIETETWIKDTVNPGGKPFDLKKLNQFNTVPFPQQLDFLQQYPIIVNSYHLKGMLLDAKPGSGKAMPLSTRVKVPNGWKALGDLKVKDIVVTPGGDTACVESIYPQGITEVYRFYFEDGRTADSHPYHLWKTTVNGVDEILTTLEVLHKARKEDVYFPLVGEINGCNPHCDTSSEVAARELVNTDVVIGDNVLELPYRDRFNIVTSVIEHVGCLISESVLSAYHENRIGMENFRRLMWSIGGTATEPVLVNGLYKVDFKHRDVGKMMTGLIGDNPRIQGMYNFSQYEDLQLKLAYWEKVENQETCCIALDNDEKLYVVDDYIVTHNTFTSLAWSQLINTAPTVVFCPMNIVDKVWVEQPLQHFKVPPRIWTSISGKVLEEGYDFYIVHYDYMTSGMGKYLENFLIALSKKHKGALKMILDESQNFNDPKAARTRKLIEWCDMELFGHHLPMSGTPLKAQGSEIFPTTCMIDPYFDKKAREFFMASYGRNRPSLMDLLSRRIGRMKFTIPELVGLGDPPPMELVKVKIPNSDQYTLDAIRLQMQIYIGERIAFYTKHMPSFLEFYNDVMTSYELSIQGNAKAVENLVKYKQIVHRFRTRGYNSFTDNQDSQFCKLVEEDIEKGLKGTTLKDFRNIKSAVKYLGLKLRGEALGNVLGRARINAIKDTIAHAGLPELIDNVEKKTLIFTSYVDALKLCEEYLTKVGYPNVTVYGENSNERDTNIKRFEKDPTLRALIAIFDSLKEGYPLIMANLTILLNAPFREYEVKQVQARTWRTGQDAPCYFKLLDMDTGDKLNIMTRSINIMEWSKEQVDILMSKEQGHELLGNITGQEMFDMGDEPETHSLYTSRSVLSLF

SEQ ID NO: 579 - protein, 1088 aa, Pseudomonas aeruginosa phage phiEL
  PP-PhiEL ORF11 precursor
MTDEQDTSLSYAKWLVKYLRCNNLPKELIDDKRLRIDWEARTDDETLLAHFNEDSLSGIKTVRFLKDFFNYQAGYDRETRNTSFLRTTEVFRQQGINNFYFILQLNNPLLKGVDPFDPNLTPEQQVWVLEECRSNFWYFLREVCRLKPNQPFLANRGNISFIWSYLNHITTYMIMPRQQGKQQRNSAKVRIVPKDTLKTITPQDTWKRIEHLRVGDQVLDRSGKPCQVIGIHPQGKRRLYRVITSDGRATDVGTEHLWTLKDYSNCLNGRALWNDYSTVDVINLLKKKVKLQLPLPAPVPGSEQDLPIDPYVLGLIYCGQDQDGKVIIPTRTDAVKQYVVDHLPRGVTVIQGVANSCLERTDNQPYLFNREHGLPDQYLEAPLNARRDLLQAFLDVRGKVGRGKVFIALNRVLGGQLAYLARSLGGTGKVTKNGVEITLPEEVPPFKFREENVVFDNRLLIERVTFVGDDDCTCIEVDNSEQLYLTDDFIVTHNTVSVQVIDFWLTYIMGRGYTSHLITLKSDNRAQFIAAIKQIRSSIPSYLINSTYKDKDAGTSLTYKAFGEDNVNTLYINVPQISQDAAGDLGRGLRVGTTNYDESGYIRFIDTIIDGCSPSSLTEMALCREQGLPYGITHITTPNTTLHPSGEFMFNKLMSATEWREKFFDCFSESHLRQMLLRASPTKTTSPSVSMVYNYLQLGKDKAWVRETIDLLGLSLAKAKIDLLLMWVEDGENRLFDDVTREAINNMKRDVVWSKEYRDCNLYVDFFVTQQELLEMAKKEYNDHFLIGVDTSSAINKDACTIVIRSMKTGKVIGVGRYPLTFLDDVTAIVVDLLDVIQNSTLIIERNYAHHMIDSLLIMLPAKGMDPFKRVFNQIYQDTVNNAKEFEEVQNTKFAYRNKAFYLKYKQYFGFVTTKTTRDVLYGLIQEAVGNTGYGLCYAKLADELINLKLKGDRIDHDAKQHDDLVIAWLLSYWFIKLGENKSLYGIPPGIALTDTRNLLNSAQNQGRTEYEPYVVQLIDKVRSKVHSLTEELMSTQDNILALRLEVEIRKLAKMLPPEQNRMMTIDVLLENAKVERNKRLLQQRRTA

SEQ ID NO: 580 - protein, 1036 aa, Pseudomonas aeruginosa phage phiEL
  PP-PhiEL ORF39 precursor
MVMKIKLREWANLPEETVLRWLNTRRWVEVTDDLDQVALTDTYALIITWHGMIIHRHYNDVPYSIKEMVPSNKVEGGEDTVYNDGTNATPINQFLKVILPTIIDPVEVDGIKRLIHIWQNKLNNLLVVMSERYVISATAESVAEFMEDEGISGIRDRVLSKEISIDEGEREFADYVRTAHSIANNTLTLLSRTGGVAINQAYQKTIIRGKVFDLNNSIMPNAITVPYAHGITNLADMLGERNAAGKAGVLSSKIKIPGGWKTMGNIRVGDEVVTPDGGTAKVLAVHPQGVTKVVRVHFKDGRYTDVSPDHLWKVRRHHWCNDKAMAKLTREEVEERVWRVITTNELKDYIGLSTKVYVQLIEPERNADKPFKIHPYVLGVLLGDGCISQKAVDITKPYQQLFDKVQSLLPEHLECVWRPNRKGDGEPKTFGIRFKDRRSEQHINWHIRDGLKELGLYGMRSWGKVIPEEYLHGSAKQRLELLQGLLDTDGTVDKHKSVSFSSSSKLLSLGVQYLVRSLGGMARLQERTPHYTHNGEKREGRTDYRVYIRYPRPEELFTLDHKRERAVSHQHTETLRLQVTHIEERPDEETQCITIDHPDHLYITDDFIVTHNSLTNNGKALKSSEWFHRKVHILSAVVADIDHFMDCGTTTTVPIRIPNMQAAMALLGKFRVTDTGELELIDQTTVWSIKPGEWVNIRSVAFCNHYNSASPCRVCYGMMASSIPYNVMMKKGADVGMWCTTSICNPIGQGMLSTKHFIRNATTRKFVPATKDKNVIYSNGDDIFLTKELCAPGTELVLKADIVNILSDIRSLDVLDNLSLDKLPYFSEVTFRYEVEDIMMGGKTLQQHAACTSVSSRNARFSLEFLNYLLSKGWANEGKKHITVDLSEWNTLSPIFTLPYVREDLDMHRARVENFITFNKRNNAWRQQIVTPRLFGEVLAEYWGLINQETKGINIIHPEVLLYSTLCRDPMRGDYSLANGKGPKYFVNFQECIKGRGAGMLMIYENQQNVLSDPKTFRVVNRQGSPLECFFSLAVS

SEQ ID NO: 581 - protein, 760 aa, Pseudomonas aeruginosa phage phiEL
  PP-PhiEL ORF40 precursor
MRATATISKANHYFRINGFYEEFAVRVILPFCKLNLCKMAKKPIPGTRKQAWFVQHVFARSNYDKSEYRLPIETLKEFVEFAGYRGYKESRLKIQDEPEIEGKDVVFEFNPGFDQFREGQGEWIEYMLSDGHLKVNNASTGFGKMQPLYAKIKVPGGWKTMREMTVGTEVIAADGTVTQVTGVYPHGKQPIYRLHFEDGRYTDAGLDHLWKVFTEETQAWTVVNTRSVQTLLAKEPDGVFIPLCEPEDGPEKPFVTDQLEGSRQQRLEHLRRLMDEKGYVRDDGSLSFSSEDEVESTTVQYLVRSLGGIARKVPSTGLYRRRQYRVYIKHPRPEELFTLTNKGGYLTSKSGNQSLKLRVNRIEFIGEHEAQCISVAHPDRLYITDDFIVTHNTYMAIHSMVKIGKRTLITMQPRYQINWVRELNKIVKLIPGDLLIWENTLESLYECLEDGKFDPKIIIIPMSRIEVFLRKGKETRDGLHMDDLIKRINPGLRIIDEGHEAIHQIFLSLMFGNIKKLFLLSATLKADDPFTNKMYQYLFPKRLRLKEAEPEHYIDVVAYLYRLNTRRYHLKTEQFGAYNDKTFEKSILKSGVLLAFYFKLVNKAFKEYYLNVRREGTKCLFFFSRVSMCDAMLELFRKEYPGWDFETFTGDDSKLKDKKDKYLKHEIIITTPNSCGTGKDIGGLVTVICAHTVASTQANKQIIGRLRALSGKFNNEIDPAFVFLVCLDLAKHVEYLAKREQVFFEKQKTFKRINSECSLD

SEQ ID NO: 582 - protein, 568 aa, Porphyra purpurea (chloroplast)
  Ppu DnaB precursor
MLTQESEDLLKQIEKLSPDFFYFKSNSLVYRAILETVNPIDKIALVSLLTALNTNNLIRQLGRLETIMKLIENSPASNIIYEYSKVILDNYVKRLLLKSGDSLCLISCSKKQITQSVITSVASQLTIAYEILEDEGTYTLAEIFASLLVSLDTKKKISINSGIFSGFWQLDLITNGFQKSDLIIIAGRPSMGKTAFAINITRHIIKTSQYYVILFSLEMSTEQLLRRILAQECHLNSQKIQSGQLTNVEWQRIVEESKILANLNFYIDDSAEISCDIIKVKVKLLRLQGKKIKLIIIDYLQLLQESKKSENRSQELSLITRSLKILARELNLPILVLSQLNRNLESRHNKRPLLSDLRESGCISKFSHIMWSHVSKPLFNFSIKKSHMHNFNKNIYQLLDQGEAFISRQDKKTTYKIRTNSEKYLELTSNHKILTLRGWQRCDQLLCNDMITTQIGFELSRKKKYLLNCIPFSLCNFETLANINISNFQNVFDFAANPIPNFIANNIIVHNSIEQDADLVIMLYRESYYNKEMEMEDMTEIIVAKHRNGPLGTFQLKFDANLANFLNV

SEQ ID NO: 583 - protein, 1312 aa, Pyrococcus species GB-D
  Psp-GBD Pol precursor
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTKQTGLTAWLNIKKK

SEQ ID NO: 584 - protein, 1065 aa, Pichia stipitis CBS 6054, taxon:322104
  Pst VMA precursor
MAGALENARKEIKKLSLDADESLYGQIYSVSGPVIIAENMIGCAMYELVKVGHDTLVGEVIRISGDKATIQVYEETAGVTVGDPVLRTGKPLSVELGPGLMETIYDGIQRPLKAIKEQSQSIYIPRGIDAPALSRTVNYDFTPGSLKVGDHITGGDIFGSIYENSLLDDHKILLPPRARGTITSIAEAGSYNVDDNVLEVEFDGKKHSYSMMHTWPVRVPRPVAEKLAADYPLLTGQRVLDSLFPCVQGGTTCIPGAFGCGKTVISQSLSKFSNSDVIIYVGCFAKGTKVLMANGDDKNIEDIAVGEEVLGKDGLPREVVALPRGRETMYEVSEKTQHRAETVFGTASYTCNATHKLVLQTNQRVNITNHVLRGESQTSVTYFQMKTAVADGREIELPKLCTKSFQHSSHGRENAWKKAEVFASTISRDPIDWTAEARDISRLGYHVRRATRQLWSPVLVEKEVLAPMIAKRGFDESIAPYMAYLVGLWVGDGYSDRATFSIDIQDVEIHERIKDFASHAGLTPRIACYKKSRDATISLHNSETRGKNVRQNLNTGNLLWSLLAEICGKKENEMLFKLVPSFLRSESIAVREYFISGLVDSDGHVKRDEADKCYSATVKTIYPAVRDGLVSVARSLGIQTSVSVEEAKEVNSVKHQESYAIYMANSSALDSVLSKCAAPRKRAEEPVCVNREPHPYTFHMVEKEEDDFYGITLSEDSDHQFLLSNLALVHNCGERGNEMAEVLMEFPELFTEINGRKEPIMKRTTLVANTSNMPVAAREASIYTGITLAEYFRDQGKNVSMIADSSSRWAEALREISGRLGEMPADQGFPAYLGAKLASFYERAGKSVALGSPERLGSVSIVAAVSPAGGDFSDPVTTSTLGITQVFWGLDKKLAQRKHFPSINTSVSYSKYTNVLDKYYDANYPEFPALRNKIKEILSDAEELEQVVQLVGKSALSDSDKITLDVASLIKEDFLQQNGYSTYDAFCPIWKTFDMMRAFISYHDEAQKAVANGAQWSKLSESTSDVKHSVSSAKFFEPSRGEAEGKTEFNTLLTSISERFAEASE

SEQ ID NO: 585 - protein, 6274 aa, Pseudomonas syringae pv. tomato str. DC3000
  Psy Fha precursor
MDVHQLALLARQPSAVLTERRSFWGMPKRGLALILANAMFWQPLLVQAEGIVVSGPNTSLSQAGNGVPIVNIATPNASGLSHNQYQQFNVESQGVILNNSTNQTQSTQLGGIIVGNSNLRGTAATTILNEVVGANASQLKGYTEVAGQAARVIVANPYGISCNGCGFINTPQVTLTTGKPVLDANGQLQRFNVQGGSISIDGVGLNADNVDQFDIITRSAKINAELHARRLNIIAGRNDVDAQTLNATALADDGGAKPELAIDSSALGGMYAGTIRLVGTEAGVGVRLAGNLAASGGDIQIDANGHLNVMQTAASAAVTVKANSAEVNGPVYAGASLAVTTAGDLVTRQNVAARDALTLSAGGQLNNSAVIEAGVNADNSRNGSGDVTLSANGLSNSGSITASRALQATVTQVLNNQGATLNGQASTRIAAAAIDNRQSGRILSQSGSVDINASQVLNSQSGLISSSGSLTITAGSLDNSQQGKLSSSSALSARISGQFLNQLGLVSANGYLLLNAATLDNRSAEISSLGNLTSTVGQFNNSEKGRLLANGSLQLTSDTLNNQNGSLAGQQNVQLTLGQLTNTGNGSVYGKNNLNLTLNGALNNDQGALRSDGTLDVRAASLSNNSGSTTSAGAASVTTSGAVVSRGGQILSDAGLTLISGSLDNSQSGRIAGNGVVLSTGAFDNQRSGNLSSTGTLQLTAAQVNNSDAGRIASAMALTAVVTGLNQTNDGRVYSNTDVSLDLSNGLLTNQGGLINAPGQLVLKNLNVVNNQSGKISSANGFTLAATSLDNTDGSLLSDKALVVRVNQLLTNLRGLVSATGLDLTAGSLNNRNGEISSLGGLTANIGQFDNREKGRLLANGALLLTADGLNNLNGIVSGQQGVQLNLGQLDNTGSGSLYAKSSLGLNVSGTLNNDQGVVRSDGTMDLKAAGLANTNGSVTSAGTGVLNFNGAAVNQGGQIVSDAQLTLTSGSLDNSQRGRIAGNGVLLSTGTFNNQQGGSLSSTGALRLTAGQVDNSAAGRIASAMALTAVVTGLNQTNDGRLYSNSDVSLDLSNGLLTNQGGLINAPGQLVLKNLSVVNNQSGKISSANGFTLAATSLDNTDGSILSDKALVVRVNQLLTNLRGLVSATGLDLTAGSLNNRNGEISSLGNLTANIGQFDNREKGRLLANGALLLTADGLNNLNGVVSGQQAVQLNLGQLNNTGAGSLYAKNALNLTLGGVLANDQGVVRSDGTMDLKAAGLANTNGSVTSAGTGVLNFNGAAVNQGGQIVSDAQLTLTSGSLDNSQRGRIAGNGVLLSTGTFNNQQGGSLSSTGALRLTAGQVDNSAAGRIASAMALTAVVIGLNQTNDGRLYSNTDVSLDMSNGLLNNQSGQISAPGQLLLKNLNVVNNQSGKISSANGFTLAATSLDNTDGSLISDKALIVRINQLLNNVRGQISASGVTLSAATLDNRNAELSSLGNLTANIGQFDNREKGRLLANGALLLTADGLNNLNGIVSGQQGVQLNLGQLTNTTGGSIYAKSSLGLTVIGAVNNDQGVLRSDGSLTLRAASLTNNAGSISSAGVASINVDGDVVNRGGQVLSDATLTLTSASLDNSQSGRIASKGLVLTTGVFDNHQDGRLTSTGELQLNAGLVNNSDAGRIASAMALTAVVTGLNQTRDGRLYSNSDVSLDLSNGVLTNQGGLINAPGQLLLKNLTSVSNRKGEISSANGFTLAATSLDNTEGSLLSDKALVVRINQWLTNLRGKISANGVNLSAATLDNRNAELSSLSTLTATLGGFDNTDKGRLLANGALLLTADTLNNQNGIVSGQQDMQLNLGQLSNTGAGSVYAKNRLGLTLTGALNNDQGVLRSDGALDLKAGSLANTGGSVTSAGVSGLATDAAVVNQGGQILSDATLTLTSASLDNSQSGRIASKGLVLTTGAFDNHQDGRLISTGTLQLNAGQVNNSEAGRIASAMALTAVVTGLDQTSDGRLYGNGDVSLDLSNGVLTNQGGQLSAPGQLLLKNLSSVNNRSGKISSANGFTLAATTLDNTAGSVISDKALIVRIDQLLTNLRGLISATGVELNAATLDNRNAELSSLGKLTATVGQFDNSGKGRLLANGALLLTADNLNNQGAGAVSGQQEVQLTLGQLTNIGSGSVYAKNTLGLTVSGALNNNQGVVRSDGTLDVSGASLANTAGSITSTGVSVLKVDGAVVNRGGQILSDSTLSLSSASVDNSQNGRIAGKGVTLATGAFDNQQGGRLTSTGTLKIDAGQVNNSDAGRIASAMALTAVVTGLDQSNDGRLYGNGDVSLDLSKGVLNNQGGLITAPGQLLLKNLTSVNNQNGEISSAKGFTLAATSLDNTAGSVLSDSALIVRVDQLLTNLRGLVSGNGIDLTANELNNQSGSVSSDADLLLTIAGTLSNQKGELTSAGNTTLNALSLANANGQVMADRFLKLVITDAIDNQAGTLGAGKGADIRAVSLDNRQAGALVTDGQLDLTLTDALDNRASGSLQAKGLMNLTSQTLDNRGGRITAQNMLMVRSASVDNRGGAIRAEKGLQLFVDALDNSQSGLSTAQKGLINSNAGLELVGTRLDNQNGLLNAAGLMQLQADSVLNGSGRIASQADLVAHIGGLTQQGGELVAQGNLTLTGNILDNQSGGLVGSTKALKIDVADIDNKAGELSSQIGVEIIAQTLDTSNGGKVLAGTALGLTVARLINLNKGLLFGNTLRLEGTRLDNAGGTLASQQDLNIGLSGALDNTGGLLSSESAMTVSAASLQNAAGSLSSADALSVTTTGALSNQAGSITTDAALTLTSASLDNSKAGKLSGKGATQVTTGTFDNSQNGRLTSSDTLRLTAGKVINQSAGRIASALALTASVTSLDQQAGELFSNTSLSLDLNNGQLNNQGGLINASGVLLLKNLNGIANQNGEISSAQAFSLNASSFDNSGGKLLSSQALTLVVNKALSNLKGNISGASLNINSDSLDNTQGMISSRAGLDVTVNTALTNAQGTLIGDGNVNLSAATADNRQGQMASKQNLDAQIGNLQQQNGQMLAQGTLTLRGDTLDNRQNGFIGATQALAINVTNIDNRGGELSSQDTMTLTGQQLNNSDKGQVLAQKALTLNIAQTTNRANGLLSSQAGLTLIGSTLDNTGGALSALKALGIDLSAALDNSQGLISGEDILTLNAGSLTNTAGSVSSAANLKLDSAGAISNQGGKLVTDGALNLTSTRLDNSQRGTISGKGLLTLKTGNFDNSQNGRVSSNDRLELTSAQLTNSSGGSIGSSQALTASVSRLSQQGGKLFSNTSLSLDLNNGQLDNQNGLINAPGALVLKNVNEVLNQNGEISSAQAFTVNAQQLNNTGGKLLSNQLLTLRIARALNNVKGMIAAAGVDAVVNTLDNTGGTLTSRNDLGLTVAGLLTNRDNGLINATQALKVGAASLDNQNGQVLGGTSLILNATSINNTAKGLINSTGTLNLTAGSLDAGNGGEVSAARDMTLVLNALSLNGGRVMGDAGLSIDMVGNDLNNLGGLITADGQLTFSRLRDLNNQSGEVSSAQSFTLSGRTLDNSSGKLISSNVLTVGATNLLNQNGLISGWQGLNVSGNRLDNRNSGTLSSRSGNLVTTLTGELLNGGNGALVSQNTLSVTADSLDNSGGILSSGTGQTLTVSGLLNNSQNGLIDSGAGLVINANALNNAAGNMTAQQDVSFGGSSLDNSAGNLSSKGAMTLDLLGSLTNTRGKLASGGTLLLRRSTAINNQAGQLISQSLMTLNTSGQLDNSNRGTVAANNTLTVVASGNVLNDADGLIYSQSANAHVQAASLSNVRGTVQSVGALRVDVVGDVNNQNGRIIAQGGDLNVSAANLYSQGGVLSSLQGLFTASVTGVLKNGYDANRQGGVIQAQRLNLTALSSFDNYGGRVSARTGEALINTASFDNRNGGLYAKGLVRVTGGNFDNSGDNDGQIAGGQVELNLSGALNNRFGIIESDSTLAVTAQSLDNQTGQLRALGGGGATNFQIGNLFDNRNGTLESANSDLILNAGSFLNGGGSLLHTGNGTFDISTANLTNAGGSIVTRGGLTLTADSWTNSSVIQAGRLTVNVGTLNQTAGGQLLASSLFSGSGSNWTNDGLIASDGSLSLNLGGTYGGNGRLSSVGTLGLSAAQVNLNAASTIAGGGDTSVSVGGQLSNVGRLTSATNLTVNAGSINNQGTLGSGQALTVTTGSLVNDRGLIFSGSNMSLRVSSLNNSYANIYSLGNLTIDRNGQGALADSIVNSSASIQSDGSMSLAASTIQNIRAILTTSNGGIYSAMIKEGACNREFYNNDCKTSTQTHTWDVTQREKLEVTAASAASGIAAGGSLSMNGGDLLNQSSTIATGGNFTATLNNLTNTGVEASDTETVTVYRSMRTSNASMWTKAAQDFTDKYWLGSSGYDASLTGLQAALADFVRITETDMPEFYKVTRLSNGDQSYAAVIQAAGAVNVNAQNDINNSVVRAGYTYVSGGSRTDTNAPGTQFSTRITVNQQLPPDLAQQQVNPLSLPGFSLPTGQNGLFRLSGQSGTAVAVAQPVGLPQSWTMGSAAVSVAQREQTVSDAQASTIQIGSVSQISNAARQLASVTRQSAGVSANASAFDTSAPGAAPIGGLVLPGHTSDSAGVTSVDSVTGIATGNQGSGVLLPVQNTGSTSGLPTITAISSGNSAAQNAGRVQGTQVSQAGQVVNGTQGSLVSAINQATTGVQSGTTATVTQVVVNAQGGQVIAPVRNPVATQGGPLVTSVGNPAVSQGVSVAAPVRNTVAAQGGPVTAAVLNPVVTQTNPVSATQNTSNQPATVAQASAITPVVSAAAQTVTRVEGLPSSSFVSRPQKYLIETNPVLTELKQFLSSDYLLAGLGYDPEVSAKRLGDGLYEQRLVQQAVVARTGQAFIDGQTSNEAQFKYLMNNAIASKQQLNLAVGVSLSSQQVAALTHDIVWLEEHEVNGEMVLVPVLYLAQADNRLGPTGALIAGNDVSLIAGQNLDNVGTLRAANNLSAAAGNDLVNSGLIEAGNRLDLLAGNDLINKAGGIIAGRDVTLTAIRGDVINERTVTSHQSAADDATWRKDFADSAARIEAANDMSLQAGRDVKNTGGVLQAGRDLSIAAGRDVAIDSAQTENGQTRGANSSNSSITQLGSTVSAGRDLTAQAGRDINVIASSIDAKRDIAMAATENLTLSSAADEQHSYGKSKKVTEQEDHVSQVSADLKAGGSVALQAGQNLAVISSRITAGKEAYLVAGENLDILAAQDSDYSLYDMKKKGSFGAKKTQRDEITDVKNIGSEITTGGDLLLSSGGDQKYQVAKLESGKDLTIESGGAVTFEGVKDLHQESHEKSKSDLAWNSSKGKGNTDETLRQSELVAKGEVAIRAVQGLKIDIKQIDQQSVSQTIDAMVKADPQLAWLKEAELRGDVDWRQVKEVHDSFKYDNSSLGQGAMLAIIIVVTVLTAGAGTFAAAGTAAGSAATGAATAAGVSATTAATIGTAANAAAVASLTSITAQGVVSTINNKGNLGAALKDTFSSDSLKSAAISGLTAGFTAGVIDPQLGGTTKPFNSLTKGFDLSTLGGAGGFALHAGAQGLASGAINTAVNGGSLGDNLVNGLVSQAGTVAAAIGFNQVGSFADQKFTEATLAGDVSGKAMWAEGGIGRTTLHALMGGAVSSATGGDFTTGAVAAGASQAMAGTLNEVFKNNPEYRQAAAQIVGLTAAGLAGGDVEKAAWVSAMADQYNRQLHPNEIPLLEKQSSSLAQEANISPAEAEKRLAQALAYYTDKDWNNALAAKGVVPDALTLKHLGIALSPLADSYAVVGDVPVVAGSKSYTPAETVALITEYRNTHTAEYADPSINNLNMQGAYAGDPKYQYADFYRKNLAVKTDFLSAVSGNLAGIAQGSGGALSDSLGSAWALMSDPVGVSEQAANGLMGLSKSPWGSFKNSVEASQTKEAMATIYDMQGNTAASAAIRAKSDLEFALNFLPANRAKTLAELGAGRKFAMDGPCCFAAGTMVSTPDGERAIDTLKVGDIVWSKPEGGGKPFAAAILATHIRTDQPIYRLKLKGKQENGQAEDESLLVTPGHPFYVPAQHGFVPVIDLKPGDRLQSLADGASENTSSEVESLELYLPVGKTYNLTVDVGHTFYVGKLKTWVHNTGPCELPEGYFGAAGGNGPKATATSAAEGATPRVSIDPPDGSFSISDWTGYPAGVPVPQGPFRLLEGTEYNAARNVANKANSALRREQGLVGQPVDVHEINPVKFGGSPTDSANKVILPRDVHRQQVTPWWNQLQKDLGK

SEQ ID NO: 586 - protein, 922 aa, Picrophilus torridus, DSM 9790
  Pto VMA precursor
MSGSIYSVSGPVVIAQDIENAKMFDVVRVGELGLIGEIIRISGNKATIQVYEDTSGLRPGEKVYSTGKPLSVELGPGLLSSIYDGIQRPLDVIRAKTGDFIAKGVNIPPLNEEKLWDFKPLVNEGQQVKSNFIIGEVDETEIIKNKIMVPYGVEGTVKSIKSGKFKVSDTVAIIETKNGDYEIKLKQIWPVREARRVFHKFPPEIPLITGQRVIDAFFPVAKGGTVAVPGPFGSGKCVTGDTPVLLADGTVMSIEDIYNKSSGTVEYKNENETLIRLDEPLRLYSFYNGHVNESTSNYIYKGKSDSIIKIRTASGREVKVTPVHKLFRFVDDKIIETEARYLNTGDFIASIKRFNNKDENYLSGDESELLGLYASYGSIEDGILIDASIKDRFINLAMNIFKLKTIKIEYRNDRVLIKNDGLKDFIARMISSGIPSEVMRSRACAASFINGYLYGKLYHDDVIKLHDNEQNILKISYMLTGLGIIHSIRNNLIEIKAENMKILNSMENELIDNNETLLISNNANDDFDLYPDEIESIEILPGPFDVYDVTTPDFGSNFVGGYGAILLHNTVIQHQLSKWSDSDIVVYVGCGERGNEMTEILSTFPELMDPKTGKPIMQRTVLIANTSNMPVAAREASIYTGVTIAEYYRDMGYNVALMADSTSRWAEALREISGRLEEMPGEEGYPAYLGRRISEFYERSGNAQIIAEDQRTGSVTLIGAVSPPGGDLSDPVVQNTLRVTRVFWALDASLASRRHFPSINWLTSYSLYTNNLSKWYTENVGPDWPEIYKTMMDLLEKESELQEIVQLVGYDALPEKEKNVLDIAKMIREDFLQQNAFDDIDTYCSIKKQYMMLKIIKTVYEMQMNALNHGMKISQITSIPARSKISRMKEVSEQDFPAFYKNIIKEINDEYNSMIEVGGVNA

SEQ ID NO: 587 - protein, 566 aa, Porphyra yezoensis chloroplast, cultivar U-51
  Pye DnaB precursor
MLTQQSISLLKSVEKISPDFFYFTSTSLLYRAALENVNHAKTKSVRNFFINLKNEKMIQDLNELNEVFSLIEQAPLSDTISEYSAVVIDNYIKRLLLACGDSLCLISCSKQLIEQKNITSIVSQLTKAYEILDEKDTQTLATILANLLVHLDTRKKISINSSILSGFTELDSITQGFKKSDLIILAGRPSMGKTAFAINITRYVINQKRSYVILFSLEMSTEQLLRRILAQECNLNGQKIQSGQLNNDEWQYVIQKSKTLANLNLYIDDSAKISTDTIKTKVKFFKLQGKNIELIIIDYLQLLQESRQSDNRSQELSLITRSLKILAKDLSLPILALSQLNRNLETRSDKRPLLSDLRESGCISKFNYLQTSLYNQLQILFNCYYKKIEVINFSAQKQQLFLAIKCSISKTGKKTVYKIITEAGKYIQLTSNHKLLTTQGWKRCDKINQNDMIAIQIKNFEEQKNVFNSFSSLTFESIQKINVTSLQIVFDLECKPLCNFISNNFIVHNSIEQDADLVIMLYRESYYTQETRSRDFTEVIIAKHRNGPTGTFQLKFNAQIAKFSDA

SEQ ID NO: 588 - protein, 1131 aa, Roseovarius species 217
  Rsp Rir1 precursor
MSRFAAPIAEQIWNMKYRFKTEDGGDASVEDSWRRIARALAVLEAEPEVWEDRFFHALEDFKFLPAGRITAGAGTARKVTLFNCFVMGTVPDDMGGIFDNLREAALTMQQGGGIGYDFSTIRPKGAEVKGVSADASGPLSFMDVWDAMCRTIMSAGSRRGAMMATMRCDHPDIEAFIAAKSDPARLRMFNLSVLITDAFMEAVKADGPWDLVFGGRVYHTVQARDLWNRIMQATYDYAEPGVIFIDRINAANNLSYCETIAATNPCVTAETWVMTDEGARQVSALLDRPFRAVVNGIAYDSGEHGFFCTGLKPVKRLSTACGRHLRLTADHLVRKVVGKTRWRQEVEWVPAGDLRPGDEVKLHDHRTAMIQTRPEDERGYLLGLLIGDGVIRDDKTLISVWPQEECIGAQPLGHPVMHKVEALLRDLPHRADFAGWQKVEGRGEYRIGTAALTALAAEYGLTRGRKTITPEIEGAETAGFGAAVLRGLFDADGSVQGAQEKGVSVRLAQSDLALLQAAQRMLARLGMNAVIYENRREAGRAFLPDGKGGQAHFETKAQHELVISGENLATYQERIGFTDVAKARRLAVALSGYKRALNRERFSAVVADVVDDGMAEVFDVQVPGVNAFDANGFYVHNCGEQPLPPYGACLLGSINLARLVTEPFATGARVDAAALDDLVRVAVRMMDNVVDVSGFPLPAQAAEAQAKRRIGLGVTGLADALLMVGLRYGSDEAVQQTEAWLHAIARAAYLASVDLAREKGAFPLFDRDAYLASGTMQAMDEDVRAAVAAHGIRNALLTSIAPTGTISLYAGNVSSGIEPVFAYSYTRKVLQKDGSRTEEEVVDYAVQMWRDRMGDAPLPSYFVNAQTLPPEDHVKMQAAAQKWVDSSISKTINCPEDISFEAFKNVYLQAWDLGCKGCTTYRPNDVTGSVLSVSETSDKVPGETRGDIPVTGGEVVYMSEPLDRPKELEGATYKLKWPDSNHAIYVTVNDIVLNGHRRPFEVFINSKNMEHYAWTVALTRMISAVFRRGGDVSFVVEELKAVFDPRGGAWMQGKYVPSILAAIGGVLEQHLVQIGFLEGEGMGLKQDPQAQIVGIDGARKGPACPACGQYDMRMIEGCMTCGSCGHSKCSG

SEQ ID NO: 589 - protein, 1032 aa, Salmonella phage SETP12
  SaP-SETP12 dpol precursor
MNLLYLDTETFSEADLKKVGSYAYAEHPTTEIVICTYAFDEGPVQVWDATDGSDMPRDLRRAMLKLQKPDSNLKLVGQNFLMFDRLVIKHCWGFELLVENIIDTMIVAFRHALPGSLASLCEVLNIDASMAKDKRGKALIQRFSKPTPKNYKIRRYTAATHPKEWAEFIAYAKSDITSMREVYKKMPKWGNSEFEDRVLWLDQVINDRGFKVDVALAEAAIEAVTRHKEELQEEAQRKYGGSLTGKDFLPILQELAPAHRIHNAQKSTLNDLLADEDLPDDARTIIEMRLGAASTASTKYAPLLLGRSSDDRRRGCLQYGGAKRTLRWAGKGFQPQNLARGYYHDDELDRGIAALLKGRAHRRFDVAKLTASTVRSCIIPEAGRKFVVADYSNVEGRGLAWLAGEETALDTFRAGLDIYCVTAGKMFGMDPDDIKKERKDLRQIGKACLHRHTQVLTDGGFKDIMAVTSTDKVWSGEKWVNTKGAHLMGWKPVINVDGVLMTEDHKILTHSWKQAKQLVSNKYMMDRALEIGMDAWLSCASYQNDKAKDNYSSNVIVERCLGGSIMTMSGRVKPLNATAAPLKQQKNIVNSISATKTQCRMMRTERDYSTGCPRRSREQQAPGIRVIKTMGQEASRYSTSGGLIKGLFLDMFKLWKAGMTRTSKWIESTQTVTTNLETFGLSAVLKTAGTDGKYLSFNESMMQPLPALLNLNGKLTYCEPVYDLIDVEDGNRFLIASDSGFLVAHNCELGLGYEGGVGAFVTFAKNLGLDLIEMAKTMDGTFPDHIWAATARGYEWARIQEAKRPPHPGEKDDRPSYILDKKVWRTCDAIKRMWRESHPETVAFWRDLKDGILAAVRNPGREFWAGAHLRRNGERAIRIWRTVEFDSSGRKVPGWWLCMELPSGRILSYPGIGVSVTKETDEDGRINTNVRIKYQGENQLTRQWTTLYTHGGKACENIVQALCRDLLAYAMLNVEAGGYPIVLSVHDELVCETPDTPDYTVAELEKLMCALPGWADGFPLVAEGAELKRYAK

SEQ ID NO: 590 - protein, 1032 aa, Salmonella phage SETP3; identical to SEQ ID NO: 589
  SaP-SETP3 dpol precursor

SEQ ID NO: 591 - protein, 821 aa, Salmonella phage SETP3
  SaP-SETP3 Helicase precursor
MSKFTRRPYQKLMTSFMLRHPRCNIWASMGSGKCLKRGTEVIMFDGTTKKVEDVIVGDVLMGPDSTPRNVLSLGRGREMMYEVKPRKGESYTVNESHILSLRTTTGIAKGSWPDNTVFDISVRDWLKLPKYVTGPNGYLKGWRVPVDFPRKEQDEALLPPYLMGLWLGDGTSSSGAITSGENEKEIRAYLESYAARNGMQIRKEGLTWSISHGNTGHKKHGFTHALKSAGVLNNKHIPHNYKCGDRRQRLELLAGLLDSDGYCDLSKAGFDWISVSERLADDFCYLCRSLGFAAYKKKTCKRCANTDVWGDYFRVSVSGDFSEVPFVRGRHQNLPKRNINKNVLNVGIESITPVGVDDYFGFTIDGDSRFLLGDFTVTHNTSSTLWVLNRLFRNGQLNDDDRVLILAPLRVASGTWPAEQARWNFPCLRVVDATGSEKRRIAALESDANVVCTNYEVIEWLIDYYGKDDWPFTVIVADESTKLKSFRSRSGGSKRAKALSKVAFGKVKRFINLTGTPSPNGLKDLWGQNWFIDAGERLGSSYTAFTDRWFNSVQKGKSAMAREYHARPGADNEIHQKMKDISLTIDAAEWFGCEAPVIVPVEIDLPKKARQAYIDMEEKLFAELESGEVEAANAAAKTSKCLQIASGAVYVSGPDGEATKDWEKVHDTKLDALESIVEELQGAPLLVAYQFKHELERILRRFPQAQAFAKGAKGNKQMESWNRGEIEILCVHPASAGHGLNLQDGGHHLAFISQGWNLEHYLQVVERIGPVRQKQAGHERPVFLYHIVAKDTLDEVVAARTDEKKSVQEELLNYMKRRGKR

SEQ ID NO: 592 - protein, 1032 aa, Salmonella phage SETP5; identical to SEQ ID NO: 589
  SaP-SETP5 dpol precursor

SEQ ID NO: 593 - protein, 1075 aa, Streptomyces avermitilis MA-4680
  Sav Helicase precursor
MDLVPALEEPLKKVLGPATAKVMAEHLGLHTVGDLLHHYPRRYEERGQLTHLADLPMDEHVTVVAQVADARLHTFASAKAPRGKGQRLEVTITDGSGRLQLVFFGNGVHKPHKDLLPGTRAMFSGKVSVFNRRLQLAHPAYELLRGADDEAAESVDSWAGALIPIYPATAKLESWKIAKSVQTVLPSVQEALDPLPDSLRDGRGLISLPEALLKIHRPHTKADIEDARARLKWDEAFVLQVALARRRHADAQLPAAARKPKPDGLLTAFDAKLPFTLTEGQQKVSKEIFDDLATEHPMHRLLQGEVGSGKAQPLDSLVLAPTGFRRMGDLREGDEVVVPNGEIALIDGVFPQGVRDVWRIVLSDGSSVECDDEHLWIVGTSCGWHRGQTPKVMTTREIRLDTFKANGSSKWYVPAATPVDLGPDVGLPLDPYLFGLLLGDGSFRHNLRLSTVDDEIRDAAADAVAPDCRLVPVTGSRCDYTIQLKQRSGGVRNPVIQALRRLDLWGKTSHGKFIPEDFKNTSIKNRLSLLQGLLDTDGTVHADGMSVSLRSASLRLAEDVAWLVRSLGGRARVLPEKAAFHVSVALPDEYAPFRLSRKADRVRPRPKYNTFRRGIRAVEYVGRKPAQCISVGHPSHAYVTDNFTVTHNTMVALRAMLAVVDSGGQAAMLAPTEVLAQQHHRSITEMMGELAEGGMLGGAEHSTKVVLLTGSMGAAARRQALLDLVTGEAGIVIGTHALIEDKVQFHDLGLVVVDEQHRFGVEQRDALRGKGKQPPHLLVMTATPIPRTVAMTVFGDLETSVLDQLPAGRSPIASHVVPAADKPHFLARAWERVREEVGKGHQAYVVCARIGDEEDDPKKAKKKSPEDEAEKRPPLAVLEVADQLAKGPLQGLGVEVLHGRMPPDDKDAVMRRFAAGERDVLVATTVIEVGVNVPNATAMVIMDADRFGVSQLHQLRGRVGRGSAAGLCLLVTEMPEASPARQRLNAVASTLDGFELSRIDLEQRREGDVLGQAQSGVRSSLRMLAVIEDEEIIAEAREEAAAVVAADPELGHLPGLRTALEALLDEEREQYLDKG

SEQ ID NO: 594 - protein, 608 aa, Saccharomyces castellii, strain CBS4309
  Sca-CBS4309 VMA precursor
ISQSLSKYSNSDSIIYVGCFAKGTEVLMADGSDKAIEAIEVGEQVMGKDGAPRTVIALPRGTETMYEVCHTTQHRNGNEKFGLMNYVCSGNHKLVLRTPQLIRTTIHELRGKHYTSVTFFVTEKSANGTIVKQRTKTFQHEFHGGEEAATKLAADFASTIDPKHIDWDIEAKDYKQLDHYVKKSSYQMINPVFKESGNLANILGDAGIEKTLAAKMAWLLGFWVGNGHMETAQFPVDSWDTQLVDRISEYGKHFNLTTTTENHYRSNHVESNKDIEIFEMNEAQIEEAEQTGVVAFDSNRKGDPSETELIEAEIFNESRPSTAGLFTPAAISPASLVTDLSVTLRGTGIGGAGVSKERNLNNIFWDIVTSFGVRTNGQGSTYEKSVPLHLSYDDIEVREQFIAGLIDSDGYVKSADNRFSATVTTIYKGVSEGLIRLARSLGIRVSVSTEKEHVDKNNVKHKSCYRVFLSGEALIGVLRFCALDRKRTAFKEFTREAVPFYFTLQEKDQDEYYGITLPDETDKQYLLSSLALVHNCGERGNEMAEVLMEFPELFTEKDGRKEPIMKRTTLVANTSNMPVAAREASIYTGITLAEYFRDQGKDVSMIAD

SEQ ID NO: 595 - protein, 545 aa, Saccharomyces cariocanus, strain="UFRJ 50791
  Scar VMA precursor
ISQSLSKYSNSDAIIYVGCFAKGTTVLMADGSIECIENIKIGDKVMGKDGKPREVIKLPRGNETMYSVVQKSQHRAHKTDSSREVPDLLKFTCNSTHELVVRTPRSVRRVSRTMKGVEYFEVISFEMVQKKVPDGRIIELVKEVSKSYPASEGPERADELVESYRKASTKPYFEWTVEARDLSLLGSHVRKATYQTYAPILYENDYFFNYMENSKFHPTIEAPKVLAYFLGLWIGDGLTDRTTFSIDSRDTSLMERVTEYAEKLDLCAEYKDRKEPKVAKTVNLYSKSVRANGIRNNLNTENPLWDAIVGLGFLKDGVKNIPSFLSTDNIGTRETFLAGLIDSDGYVTDEHGITATVKTIHTSVRDGLVSVARSLGLVISVNAEPAKIDMSGTSHKMCYAIYMSGGDILLNVLSKCASFKKFRPAPVAPPVRECRGFYFELQELEEDDYYGITLSDDSDHQFLLANQVVVHNCGERGNEMAEVLMEFPELYTEMSGTKEPIMKRTTLVANTSNMPVAAREASIYTGITLAEYFRDQGKNVSMIAD

SEQ ID NO: 596 - protein, 1071 aa, Saccharomyces cerevisiae (nucleus)
  Sce VMA precursor
MAGAIENARKEIKRISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLSTMQERFAESTD

SEQ ID NO: 597 - protein, 516 aa, Saccharomyces cerevisiae strain DH1-1A
  Sce-DH1-1A VMA precursor
PGAFGCGKTVISQSLSKYSNSDAIIYVGCFAKGTNVLMADGSIECIENIEVGNKVMGKDGRPREVIKLPRGSETMYSVVQKSQHRAHKSDSSREMPELLKFTCNATHELVVRTPRSVRRLSRTIKGVEYFEVITFEMGQKKAPDGRIVELVKEVSKSYPVSEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGVRNNLNTENPLWDAIIGLGFLKDGVKNIPSFLSTDNIGTRETFLAGLIDSDGYVTDEHGIKATIKTIHTSVRDGLVSLARSLGLVASVNAEPAKVDMNGTKHKISYAIYMSGGDVLLNVLSKCAGSKKFRPAPVATFVRECQGFYFELQELKENDYYGITLSDDSDHQFLLANQVVVHNCGERGNEMAEVLMEFPELYTKMSGTKEPIMKRTT

SEQ ID NO: 598 - protein, 1022 aa, Saccharomyces cerevisiae OUT7091
  Sce-OUT7091 VMA precursor
GAIYSVSGPVVIAENMIGCAMYELVKVGHANLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECPGFYFELQELKEDDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRG

SEQ ID NO: 599 - protein, 1022 aa, Saccharomyces cerevisiae OUT7112
  Sce-OUT7112 VMA precursor
GAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGSETMYSVVQKSQHRAHKSDSSREMPELLKFTCNATHELVVRTPRSVRRLSRTIKGVEYFEVITFEMGQKKAPDGRIVELVKEVSKSYPVSEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGVRNNLNTENPLWDAIIGLGFLKDGVKNIPSFLSTDNIGTRETFLAGLIDSDGYVTDEHGIKATIKTIHTSVRDGLVSLARSLGLVASVNAEPAKVDMNGTKHKISYAIYMSGGDVLLNVLSKCAGSKKFRPAPVATFVRECQGFYFELQELKENDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNALNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRG

SEQ ID NO: 600 - protein, 592 aa, Saccharomyces dairenensis, strain CBS 421
  Sda VMA precursor
ISQSLSKYSNSDTIIYVGCFAKGTQVMMADGSDKSIEEIQIGEQVMGKDGNPRTVIALPRGKETMYEVCHITPHRTTSGENFGVMDYVCSGNHKLVLRTPQNVTLTTHELDGQTYTNVSYFALEESAYGQIVAKKTKSYQHQRHGGKQETEKKVNEFLATINPDSIEWDVEAKDYKKLGYNVKKSSHQMINPVFKESGNLIAKLNELGFSKEIAPQMGWLLGFWVGNGSITTSSFSIDSLDTQLLDRITEYGKLFALTTTSATNHCRNYSGSGNQDIELSKINNGKVETDGTITFDDDTEREPSEQELIDMESSGCKASSEMTVALGAPLVRGNAIRQLLTENNVFLKLIESFGVRKENGSEYVKAIPMHLSYDDIEVREQFIAGLVDSIGHVKRTSNGTIECAAISTAYKSVSEGLIRLARSLGIKVSVTTKRECLDKHNVKHQICYSICLSGATLSGALRFCALDKNNANSKKPFVRGPVPFYFTLKEKDEDNYYGITLPDSTDKQYLLSSLALVHNCGERGNEMAEVLMEFPELFTEQTGRKEPIMKRTTLVANTSNMPVAAREASIYTGITLAEYFRDQGKDVSMIAD

SEQ ID NO: 601 - protein, 969 aa, Staphylococcus epidermidis RP62A
  Sep RIR1 precursor
MSKWIEKNNEIMRRDELGQLSLSKDKEAIKLYLEHIKSKTKQFSNQIARLRYLVEEDYYIDVFKDYSEETLLELLDYAYSFGFEFQSFMAASKFYDTYALKTRDKSQWLEDFEQHNVIVSLYLAGGDVDLAKRYIKAHTLQTVQTATPTYLNAGRKQRGELASCYLFTMDDTLNSINFIRSQVSQASKIAGGVAVNLTRLRGRGATLKGVKNVGKGIVPVAKLIEGEVSYADQLGQRAGAGAAYLNIFHSDVIELLNTKKVNADEDTRLATLSIGLIVPSLFFDLAKEDKDLYMFEPYSIQEEFGKDVILDDININDWYDKFVENENVIKHKINAREMLNLIAQIQLQSGYPYIMYKDNANKNHALNELGEIKMSNLCVTGDTELLTEKGYVKAKDLYESQEDLKVVIDNRTKNYDINNKGTDIVNAIPMQLTAKQAEIYEITTKQGFKIKSTEWHKYYRKINDSIEKVQLNQLEVGDKLLVQSGNGSYGDFHDPKLAFLMGLIAGDGTFGRDGSVKIYLYHEKQYLKETIEELVAYIIDKYRNKNEFLHHSANLHPKFVENKELQKLTISSVELYKILSRFGFNRETKLRFPNLLKNATKNTITAYLSGLYQMDACVNTNEKYKAMSIELTTISEELARDIQMQLLNLGVYSSIYQSEREISLLPDGNGGMKEYKVQNTYKISIQDRSSRDLFMKEVALKPKDIHKAMIFNLTLRPNSRKPKHDFTAEITEIKYIGKEDVYDTTQEDYHSLIFNGIVTGNCTEIFQYMHVSDIKDYYEPDELGQDIICNLASLNMVKSIEEKEIEESIRTGMRALTFVANNSRIEHLPTVHKANKNNRAVGLGVMSFHSMCAKNKIRYGSEESLDLLNVYCMMMDYYSLDESMKIAVERNDKFYGFDQTDYKAKDGKEFGEYFYKNNRVTKNVEPITPKVKEIFKGIYIPTKEDWQRLAREVDKNGLYNSYRLSIAPY

SEQ ID NO: 602 - protein, 1067 aa, Saccharomyces exiguus, strain="IFO1128"
  Sex-IFO1128 VMA precursor
LEDHDESEYGSIYSVSGPVIVAENMIGCAMYELVKVGHDNLVGEVIRIDGDKATIQVYEETAGATVGDPVLRTGKPLSVELGPGLMETIYDGIQRPLKTIKDISQSIYIPRGIDAPALSRDIKWNFTPGKYVVGDHISGGDIFGSIFENSLLDNHKILLPPRARGTITWIAPAGEYTVDEKVLEVEFDGVKSDYSMYHTWPVRVPRPVAEKLSADYPLLTGQRVLDALFPCVQGGTTCIPGAFGCGKTVISQSLSKYSNSDAIIYVGCFAKGTQVMMADGSDKSIEDIQLGENVMGKDGTPRTVISLPRGKETMYEVCHSSTKGTTKDTLMNYVCSGNHKIVMQTPQQIGITEHGIDGKTYTSVSYFALRDSQHGYPIVKKLTKSFEHQQHGGKEQTLITVNNFVSSLKSEPINWDVEAKHYESLGHYVKKCSYQLINPVFHQSGKLAQEIASLNYSKDKAPLLAWLIGFWVGNGAMRHSQFVVESQDIELVNRIQDIAGLLNLSATTACYYSGSKDDEAKLAKLNSSSAEGFEDDLEGNPSVKELADMDRLSESKTATLPTAFGVENIDELIISLGEGRGNGNVFAQVIGSFGIDLADKDTLVTKIAHELAGDAFEVREQFVAGLVDAAGYVRKDVYDHASEATISTESKSTVLGLVKIARSLGIKITVTSDDSDDSDEHDHAHCGHDHGSSSSYTAVMTGDALTNSMRFCAIGRNRVAAKEFMRQAVPFYFSLEKKSEDDYYGITVPDNTDKQYLLSSMALVHNCGERGNEMAEVLMEFPELFTEINGRKEPIMKRTTLVANTSNMPVAAREASIYTGITLAEYFRDQGKNVSMIADSSSRWAEALREISGRLGEMPADQGFPAYLGAKLASFYERAGKAVALGSPDRIGSVSIVAAVSPAGGDFSDPVTTATLGITQVFWGLDKKLAQRKHFPSINTSVSYSKYTNVLDKFYDQNYPEFPTLRNRMKEILSNAEELEQVVQLVGKSALSDSDKITLDVASLIKEDFLQQNGYSTYDAFCPIWKTFDMMKAFIAYHDEAQKSVANGANWSKLAEATSDVKHQVSS

SEQ ID NO: 603 - protein, 1080 aa, Stigeoclonium helveticum, strain UTEX 441
  She RPB2 (RpoB) precursor
MSTSQSLNIIPIEYSLQTYQRSNQDTSMLHRPVVKEGEWVQAGDLLSDCASSIGGEFSIGQNILIAYLPWEGYNYEDAILISERLVYDDLYTSIHIERYDISTEKNPYGIEKITKDIVLLKDTTELNHLDKNGIAQLGAWLKEGDILVGKITPTESKKEVARYVQLYNDILGKKINYAIRDSSLRVPRGLEAKVIRVKTFPERKNETKNWENKIGLKSKALAFSVQHFLSKNQSNKKRTLSLKSKWEKETSLSSFSSLAWQKKSPLFFVFKNGIFEKLKNFPKKKKKNERVFALKKKSSKKFRFFELQKKFRFFFRNFFFFKAPKKKSPLFFFFKSETFDKERNFQKMSPNQSKQNWVKISIKKEWQKVGSFGKKKASKGKISFFPSFPQASLVGKASFFSPSRFEKKRDASNFLKSSCISSVHIYLAEKRKVQVGDKMAGRHGNKGIISQILPRQDMPYLPDGTPIDMALNPLGVPSRMNVGQIYECLLGLAGKHLGEQYRIQPFDEAFGPEASRSFVFSKLYSAKTKTGQSWLFQPTNPGKLKLFDGRTGNCFDQAITTGYSYMIKLVHLVDEKIHCLTVDHEVLTTKGWIPLNKVKTSHFVATLKKNGQLVYQNPTNIYHYPEFKGELYHIKNVNLDLLVTLNHRMYVKNGIIEATSSVDYQLIPAKDIVGQHKKYCKTAFWDKENYQFILPSVISNSIVIPEKTMNMEAWLQFFGIWIAEGWALTNTISNNNVTNFNQSSSSPYVVQISIKKKKVLEILNNVIPILGYSFNYYDNNITICDKQLWAYLRPLSLGNPYRKLPIWVWDLSQDQARVLLLAMITVFKNGTNSKWEKAASLSSRLSLASVFPEFLKKRIDKGLSYYTSSVELADDISRLALHAGWSGNNYLLKKKGSISSFDGKQIICQFDIWRISIIQSKNQPAVNHGYHSKGKEEVLPYQGAVYCLSVPNEIFYVRRNGLSVWTGNSRSSGPYSLITQQPLKGRSKHGGQRLGEMEVWAIEAYGAAFTLLELLTIKSDDVTGRLTIWDYVLYKKPLYIGTPASFKVLICELQALCLDIGIYKADKSNILKQINVSSMG

SEQ ID NO: 604 - protein, 968 aa, Shigella flexneri 5 str. 8401
  ShP-Sfv-5 Primase precursor
MRPSELSDLLWAQVDRVAPHLLPNGKIEGHEWVAGNVNGDKGNSLKVNLIGKKKWADFAEGDGGDMLDLWMACRGINLHQAMQEAKAFLGIKDDDHHFDARREKKFSRPDRKKIARYVTRTESHLEYLQSRGISPEVVKRYEVVSGKVWNGERELDALVLPYKRDGELLQVKRISTERPDGKKVIMAEGDCEPCLFGWQALDAGVRAVVLCEGEIDCMSYAQYGISALSVPFGGGKGAKQQWIEFEYHNLDRFEEIFISMDVDDVGREAAREIVSRLGEHRCRLVTLPYKDINECLMNGVTEDEIWQYIGTASYFDPEELYSAREFYQDTINAFYGKQQYLFNPPWESLADKFQFREAELTLVNGVNGHGKACPLNEPILLADGTWTTHGNVKIGDQVASVDGNPSTVTGIFPQGVRDVYRVTFEDGRYVDCAGDHLWEVTSRGFTKGEKRRVIDTFGLKRLSETKRHKNGVRIPEITGDFGDHSEPLAWVIGSLLGDGSLSNGSVKFSNVEPYMIERMKAELPDYNFSGDGKDWLISTARGQVNPLMETLRGYGLMGCTAKNKFIPRVFFSANKSTRIGMLCGLLETDGYVEKDGTLVFSSASEELRNGVVQLVNSLGGSCRTRVKTGVTYTYKDDKQHGMDSYEARIRLTREIREAIRSPRLNGRLTAHRFEGCGVFVRNVEKIGNAECLCIMVDHPRHLYVTRGYVATHNTEVVGHMALEAMRQGVKTCIASLELKPGILLKRLTRQATCCKMPPVLEIDSAFKFYDERLWVFGLTGTAKADRLIEIFDYARRRYGIQLFIIDSLMKCGIGDDDYNGQKAFVDSICDFKNKTNSHVILVTHSRKGDSEEKPTGKMDVKGSGAITGLTDNLFIIWRNKARERALQRVQSGEKMSEKDEQLLASPASVLMLEKQRNGEGWEGGVPLFLDEQSHQFLQLESGSPYSYIANMPKSEYDEAWRQENVTEY

SEQ ID NO: 605 - protein, 1060 aa, Staphylothermus marinus F1
  Smar 1471 precursor
MFSRRERKERLTKLPGEEEVSEAVKSIIVPAEPIQVAKRDPSWRIIESYYVYKPFVKIVIAETPQGPMYFVEEYGLTPSDKEVLEKLTDILMDEIRPPTRPEDIKDLKGYVFKETERIADKYREKLGLVGARKIKLLYYIERNLLGYGPIDPLMKDPNIEDISCNGVNIPIYVWHKKYESIPTNITFIDEDYLNEFVMKMAHMAGKHISIAFPILDAMLPEKHRLAATFGREVSVKGPTFTIRKFRERPFSVTEIIQSGVINSLVAAYLWTLIEHGKTAMIAGGTGVGKTTMLNVISMFIRPGMKIVTIEDTPEINLPHPNWVQLTSRETYLVGTSSLGTNIRLFDLVKLSLRYRPDYIIVGEVRGEEAFVLFQAMASVSYDTPVLIRDPINKIHLVKIGEFIDKFYEEGEERTAKHVNGYYVLSHDGFQVVWKPIKYVLRHRTNEIYEIIYEGGGKLEATGSHSVFVLDPDTLDIVEKPVMLLNKGEYLVSFNGVKENKDHQTIDLIDLVSDYNDVYVDNIPSELKKHTGGRNPIPLKQYMILRKRVITKKNNSLIKLRRSKYTLPIRLVLDEKLAFLFGAYIANGCVKERRDKLICFTFGKSAKNIADKVMNIMYEKFNIKPFIDDRGTYIIYEYPHTLLAIIFEKLLGRKLEEKKMPEILWSSPKSVIRAFFEGLRAYSQRTLRRRYTSYTTANKNLAYQLLWLARFAGFYSVLKEEKEAGKNNGKTYYHVIVYLDQSYRKPNASERVPVKPILKLIKYTKPRTMPPELAYIKRREFISRKTALKALEWIRRDGSFTDFSREYLRKIESLINGDIIVLKIKDVRKKQYKGYVYDISVPITEAFFGGNIPILLHNTGHGGLSTIHAETLDYAIKRLTSPPMNIPPTYMKLMNTFIHLQRVIARIEKGVVRVRRRATIVQEVEDFGKYRTIAVWDPRTDQFKVNLEESLHLRDIAAKRGLELEDIIDEIYRKATVLNWMIYKNIFNVWDVSRIIFNYYYDPVSVYKRAVRELEEAGREAGVPTMVAPEEVASTEELVGGTKEMGEATKELFERTRELEK

SEQ ID NO: 606 - protein, 1047 aa, Staphylothermus marinus F1
  Smar MCM2 precursor
MTYTLEKEKTEPDLVTRFKRFLWDFRDRRTGMFKYRERISHMALMGQRSLLIDFNDITLFDRGLAHIIENNPDTAIEAASIAIKELMRRENPEYAESVDKFYPRFRNPSKVLRIRELTSEYIGKFVAVEGILTRLTRVEARLVKAVFKHAECGAEFEWPEEGEMGERIEKPSYCPICGKTGKFQLLLNKSRFIDWQKIVVQEKPEEIPPGQIPRSIEVVLTGDLVDSARPGDRVLVTGILRVMPTSSVQRGIGKSVFGFYLEANYVDVQQKVLEEIEITREDEDKIKELARDPWIREKIIASIAPAIYGHWNIKEAIALLLFGGVPKLLPDGTRIRGDIHILLVGDPGTAKSQMLQYTAKIAPRGIYTSGKGSTAAGLTASVLRDKATGEYYLEAGALVLADGGVACIDEIDKMREEDRSAIHEALEQQSYHKDFKIMLADGRKVRIGDLVDELIGKNREKVIKGKDTEILFVDDLFLLSYNMRSGEQVLVKADRVSRHKAPDQFIKLRFSNGAEIIVTPEHPVLIINNGKIKTVRADTVRKGTLTIGVLGHKIIKEVNEDDIINNIRRKIVLDKELPYIHAKNISEAVEMRDQLMSIDIPTFIVKHKNEIRLYPSGPCSLRRLLLMHGVEEVVFSDELLYEIMNCHLYPATWYELLYSMGLTKIAKELNVYDFEILAGIIKKVEKEVIMLSQVLGLRNETQTELLHLKSRRELLIRLKDKLDMLRKRLKDLEEALGKDAVIRMITDVEVIKNTDSDWVYDITIEPYHLFVSDGLILHNTVSIAKAGIVARLNARASVLAAGNPKLGRYDHSLPVSKNIDLPPPILSRFDLIFIVEDIPEKTKDTLLAKHILDIHTDYEKAKPLIDTQLLKKYISYARRYIRPKLTQEAKKLLLDFYVNMRLSGVKASKEGPPAIAMTPRQLEALIRLSEAHAKMALKTKATIEDAEEAIRLMYYSLRKVGYDVKSGRLDIDLVELGVSRSKQVKMKEFMKFIDKVFEEYDEIEYKELYNLAKEKGFDKEFVIEMIRRLKKDGLVYEPRPGVLSKVY

SEQ ID NO: 607 - protein, 1046 aa, Saccharomyces pastorianus IFO11023
  Spa VMA precursor
ISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPGRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGSETMYSVVQKSQHRAHKSDSSREMPELLKFTCNATHELVVRTPRSVRRLSRTIKGVEYFEVITFEMGQKKAPDGRIVELVKEVSKSYPVSEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGVRNNLNTENPLWDAIIGLGFLKDGVKNIPSFLSTDNIGTRETFLAGLIDSDGYVTDEHGIKATIKTIHTSVRDGLVSLARSLGLVASVNAEPAKVDMNGTKHKISYAIYMSGGDVLLNVLSKCAGSKKFRPAPVATFVRECQGFYFELQELKENDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLS

SEQ ID NO: 608 - protein, 768 aa, Spirulina platensis, strain C1
  Spl DnaX precursor
MTYEPLHHKYRPQTFADLVGQEAIAQTLTNAIRSRRIAPAYLFTGPRGTGKTSSARILAKSLNCLQTSNPTETPCGICEVCRGITTGATLDFVEIDAASNTGVDHIRDLIERTQFSPVQCRYKVYVIDECLTGDALILSDRGWLRIDDPTLQECRVLSYNESTQQWEWQQVLRWLDQGVRETWKIKTFQTEIKCTGNHLIRTDKGWIKAANITPKMKILSPEIDAAVKTALQDVESIEKLGVNHVYDIEVEHNHNFVANGLLVHNCHMLSTAAFNALLKTLEEPPDRVVFVLATTDPQRVLPTIISRCQRFDFRRIPLQAMATHLETIAAKENIAITPEAVMMVAQIAQGGLRDAESLLDQLSLLSGEITVERVWDLVGAVPERDLMTLLEAIAEGKATAILDQTRELLNRGRDPLIVLQNLGEFYRDLLIAKTAPNRQDLVKLTQPTWESLCAFSQRWEHEIILAGQKHLRDSEVQIKNTTQPRLWLEVTLLGLLPEALRPQTVSTGVVNVQPQPISNQPTSKMRSQPVYKPPAPAQPVSQAVSVPDAPPPPPPPPQPTTANQEEAVNYSLEELWEQILSAIEQLGTQALMRQHGCLRSHHGNVVCIGLKSHPLLKIAQAKISSLEVACQKVFNTKIQVNLEVGMGAVSPGVHPEKTPISQRVQSPPPPPPEPPPPTREPETERPPELTTPKIEDISVKVADNDNNSPVDDVATAAEKLAEFFDGEIIPWYPENTQVTTVSSSSVALEDTIEFYSPEDDDSEDDVPF

SEQ ID NO: 609 - protein, 850 aa, Salinibacter ruber DSM 13855
  Sru DnaB precursor
MRGGTGEQQREQAQAVHEQSGRVPPQAVDVEKSVLGAMLIEREAIPQAIEILPSDAFYESKHQSIYGCIQDLFERGNPVDLVTLTEELRRRDKLEEIGGAYYLTELTTQVASAANVEYHARIIAEKSLLRRMIETMTTVVQKAYDPGADAFELLDEAESKIFQISDNQLRKAAAPMNEVVKDTLERLETIHGQDGGITGVPSGFPKLDDLTSGWQDSDLIIIAARPSMGKCLGKGTPVMMYDGRTKPVEKVEVGDRLMGDDGSPRTVQSLARGREQMYWVRQKRGMDYRVNESHILSLKKSRREGARDRGSIADISVRDYLDQSDKWKDDNKGFKVAAEFPDQPVPLDPYFLGLWLGDGKSDNARIYTTDEEVITGLQEIAEKRGDTISVSDEHRRCPAYLVKSGDRGGAMATRESVQGALRALGVLGDKHIPHLYLGNSRGKRLRLLAGLIDSDGHLNDGHGGTYEITQSSEQLARDIKFLCDTLGYRTSLTQKTARISSTGYESEVHRVRFNGNVDEIPVRVERKKASPWTDVRDWRMTGIDVEPDGVGDYFGFTLDGNGRFLLGDGTVTHNTAFALASAQNAATHPERSTGVAIFSLEMGAQQLAQRMLTSEARVDAHRARTGRMKDDDWQRLARAAGALSDADIYIDDTPGLSVLELRAKCRRLKAEHELGLVVVDYLQLMQASGANLRSGANREQEIAHISRSLKGLAKELDIPVIALSQLNRAVENRGGDKRPQLSDLRESGSIEQDADVVSFIYRAERYGITVDEQGNSTEGIAEIIVGKQRNGPIGSVELAFVDQYARFEPLTTQYDNPGGGPPQGDGSAPMPPDGNAGGGGGNSFEDDAPF

SEQ ID NO: 610 - protein, 1162 aa, Salinibacter ruber DSM 13855
  Sru PolBc precursor
MSSPPAVNTPAPADATQSAADTALFGKDPMPRLVDVHPMMDRPSNEPARVRVYQRSEDFASIHEQEDTFFPFFFLSDFSLLADRYRNGDVHTATPLNGDNFYQYLLTFETWSDYWDALRQVEHRSDSDQQAPDELYRVGSPAQQYLMQTGRSCLLGMTLDDLHRLQLDIEVYSEGSFPNADRPDDKVIIVALSDNRGWDEVLHLRDGIGEEQLLQELVYVLQERDPDVIEGHNIFEFDLAYLLDRCALHGVDFAIGRDGSVPRTYDSSMRFAERTVDYPAVDIVGRHVIDTYFQVMSFDVFSRDLPDYSLKTAARYFDLAPEERTYIEGTEIAKAWRTDRATLLEYALDDVIETKRLAGHLSGSTFYLAQMLPMTYGSSARRGPAGKIESLFVREYLRRRHALPRSEWGSQSMGGYTDIFITGVLGPIVYADVESLYPSIMLNYDVQPSGDTLDLFPQLLERLTDLRLKTKQDMKDAEEEEVRSELDARQSSYKVLINCFDPETEVVTVDGIRHVEEIEVGDRVYSLNPDTGAVEIKPVTATQSQHYAGPMVEIKNQHTDFLVTPNHRFLTQRFTSGEYTDLEWETAGDMLGDRIRRRLPSLRSLPATQERPGPISLSAVCDRLAIEHKTGPRGIKELRRQARWQPEEYELTDWLRILGWFATEGTLYKSKARQYENGNVRGVSYQTTLCQKNDIGRSEIATLLNRTGITYSSDQNDHSFCSKVLYEILEAECGSDSFSKHLPPWIFQLGPKDLKIVFDTLMQGDSAANGDRFTTSSNQLAEDFIRLAMHIGRRAFHMPNDGSHRIQVNTVRGQRPTIKPKHRQQVDYDGMIHCLTVADNHTVLAGRNRKFNWTGQSFYGLLGFGLSAFNDFEEADRVARTGQQILRQLIDEIRARGGTVIEVDTDGVLFVPPEDVRGEQAEIDYTVSLTEAMPEGIRVGFDGRFKKMLSYKKKNYALLTYDDELKFKGSSLISRSNEPFGRDFVRKAIRRLLDHDVAGLHELYVDTRDKIVNSDWEGVERFARTETLKDTLEQYEADVEAGQRPRAATYELAKEKQNRTGKPVKKGDRITYYITGDDATVTAFKHCRRAEEWDPEDPDENTAYYLKRLDEFASKFEPFFDEADFRLVFSPEDLFGFSADGIEIQREEHASDYAEDQEDVPF

SEQ ID NO: 611 - protein, 1116 aa, Synechocystis species, strain PCC6803
  Ssp DnaX precursor
MAYEPLHHKYRPQTFADLVGQTAIAATLSNAIEQERIVPAYLFTGPRGTGKTSSARILAKSLNCIAGDRPTATPCGQCATCRAITNGSALDVIEIDAASNTGVDNIREIIERAQFAPVQCRYKVYVIDECLTGDSQVLTRNGLMSIDNPQIKGREVLSYNETLQQWEYKKVLRWLDRGEKQTLSIKTKNSTVRCTANHLIRTEQGWTRAENITPGMKILSPASVDVDNLSQSTALTASLGGLSGAINYEAINTDKKNTTLSLSLKKQKPQDPFVNADVAKNLIFQHFCSAKEEKLKVSNPIGEDIPTKKATDFGISEQKKLHQGQNRWEQKFSVLSTEPCLGMEVLTIPTHIADSPACDGPTAPSSQNGWNIKRQDWDVCHPKYDSQPIKAMGKVPSAVKPVVPQTLLMFSAQSNLEVKENKFLRNGSRISLKKEWLGGTWTTVPSLFPNLGVHQFSYTQRAFSRKKINLLLNGLPIEDIPPVQNPIAEALTAKPITTQKWEQWPPASGYRTWKSIPSPQWHTNFEEVESVTKGQVEKVYDLEVEDNHNFVANGLLVHNCHMLSTAAFNALLKTLEEPPERVVFVLATTDPQRVLPTIISRCQRFDYRRIPLQAMVDHLRYIAGRENINIDQPALTLVAQIANGGLRDAESLLDQLSLLPDLITPDKVWDLVGAVPEQDLLALLEAIASDDAETLLATCRQILNRGREPLVVLQNLASFYLNLLIAQTAPQRSDLVAVTAETWQALCDTAPQWQRGVILQGQQKLKESEIQIRNTTQPRLWLEVTLLGLLPSACGLDTGAVSQTAVRTPVAQPITPPKPSNVVTFPGGSHNHLTVVDSPTMIPVSEPIVLEEKLEADVEPSSFEPSNAHWDLTQLWSETLNNLGALSQSLFKSFGSLINLVGNNATVSVTTQQLLKIAAGKKDELEAALGQACGQSVKVNLVVGKPSTPETTPVNSAPPPSHSKPPAFAPEPSPPPTAAVNANPAPTVPPSPPAIARGPATSEIKPSPRRESNNFSNPSRPKPKPAPAMEEPPPTDIGDSATRKAIEQFAKNFDGEIVASDAAPKQESDNGDDLSTEPTAELGQQPMDHNGHLQINQPTVLNRPAIAPEEEEDLPF

SEQ ID NO: 612 - protein, 1078 aa, Synechocystis species, strain PCC6803
  Ssp GyrB precursor
MTMTTTNYGADQIQVLEGLEPVRKRPGMYIGSTGPKGLHHLVYEVVDNAIDEALAGYCTHIEIDINADGSVTVVDNGRGIPTDIHPTTGRSALETVLTVLHAGGKFGGGGYKVSGGLHGVGVSVVNALSEWVEVKVWRQGKEHFQRFERGNPIGTLEATPNEGHSTGTQVSFLPDTQIFKDGIEFDYHTLASRLKELAYLNAGVRITFGDRRADSLKEEQFYYEGGIREYVTYMTTDKTPLHEEIIYTSGEKNDVQVEVALQWCVDAYSDTLLGFANNIRTIDGGTHLEGLKAVLTRTLNSVARKRNKLKDGDSNLGGENIREGLTGVISVKVPDPEFEGQTKTKLGNTEVRGIVDTLVGEALTEFLEFNPGVADAIIEKAVQAFKAAEAARRARELVRRKSVLESSTLPGKLADCSSKDPSESEIFIVEGDSAGGCFSGDTLVALTDGRSVSFEQLVEEEKQGKQNFCYTIRHDGSIGVEKIINARKTKTNAKVIKVTLDNGESIICTPDHKFMLRDGSYKCAMDLTLDDSLMPLHRKISTTEDSGITIDGYEMVWSPRSDSWLFTHLVADWYNRWQGIYIAEEKQHCHHKDFNKRNNNPDNLIRLSPEKHLALHRKHISKTLHRPDVVEKCRRIHQSPEFRRKMSARMQSPETRAILSKQAQAQWQNETYKLTMMESWRSFYDSNEDYRQQNAEQLNRAQQEYWAQAENRTAQAERVRQHFAQNPGLRQQYSENAVKQWNNPELLKWRQKKTKEQWTPEFREKRREALAQTYYRKTLAALKQVEIENGYLDISAYDSYRISTKDKSLLRFDRFCERYFENDENLAREAVLNYNHRIVNIEAVSETIDVYDIEVPHTHNFALASGVFVHNSAKQGRDRRFQAILPLRGKILNIEKTDDAKIYKNTEIQALITALGLGIKGDDFDISSLRYHRVVIMTDADVDGAHIRTLLLTFFYRYQRDLVDQGYIYIACPPLYKLERGKNHFYCYSDRELQEQISQFPPNANYTIQRFKGLGEMMPQQLWDTTMNPESRTMKRVHIEDAAEADRIFTVLMGDRVAPRREFIETYGTKLDLTDLDI

SEQ ID NO: 613 - protein, 591 aa, Synechococcus species JA-2-3B'a(2-13)
  Ssp-JA2 DnaB precursor
MISDYDLTGGDRLPPQNIEAEEEILGGILLDPDALVRVAEFLRPEMFYISAHQEIYRAALQLHSQGQPTDLMTVSAWLADHHLLERVGGTGAIRRLLEQTVSSVNIDQYARLVMDKYMRRQLIQVSNTLARLAYDTSQPLSQVMDQAEQQVFGLTQERVQRSLIPASEVLVNIFSDLEEKFQSGAQLPGIPTKFIDLDNLTQGLQRSDLLILAGRPSMGKTSLALNIAQNVAAYAKQPVAIFSLEMSREQLVQRLLASEARIDSSRLRSGRISEHEWQRLGQAIGFLSQLPLFIDDTPDCTVTEIRSKARRLQAEQGGTLGMVLIDYLQLMQGSAADNRVQELSRITRGLKAMAKELMVPVLVLSQLSRAVESRSDKRPQLADLRESGCLAGDTQVMDADRGKIWRLDQLAALPAAAELPRLLSLNGRGRLVPQQPVKVFCSGRQPTCVLKTRLNFSIRATGNHPFLTPDGWKTLDELQLEEEVAVVVQEGLIWDPVVLISEPGEPQPVYDIEMPRHHNFVANGLLVHNSIEQDADLVMMIYRPEYYDPNTSDRGIAEVIIAKHRNGPTGTVRLLFESQYTQFRNLADPNR

SEQ ID NO: 614 - protein, 1137 aa, Synechococcus species JA-2-3B'a(2-13)
  Ssp-JA2 RIR1 precursor
MQGLDPAETTGSLPLGEFPATAPAASPVFYRTYSRRRPDGSRETWSEVCDRTLADIARLGRFTPQERQLVERLQRQLKALISGRALWVMGTDWIQKPENFSGAYNCTSLAVVDWRAFGLMMDLAMMGCGTGAVLEPQFIRQLPPIVNRLRVHVKGSIGATPPEERQEHTRIHRQGSQVHIQVGDSRRGWVESYQALLELASDPSFGGQVEVTVDLSDVRPAGERLKGFGGVANPIKLPGLYERCAAILNRAVGRQLNSVECCLLIDEAAVVVVAGNIRRSAGIRQFAADDQLGSTAKDNLWQQDENGNWRIDPERDALRMANHTRVFHRKPTREECVEAVRKQFYSGEGAIQWAGEAVARANCDLIPPDLKPDFLKAYEAGTAREWLKGRDPSLGEEELQDRLWRYGLNPCVTADTWVHTGDGPRQVRDLIGKQHSTYVNGELFSTTPEGFFYSGTKPVLKLLTKEGFSLRLTGNHRVLKVTAQTQKAQYTEWVPAESLQPGDRILLHNHRDLTSWDGAGTWEEGWLLGNLLGDGGLTATPWNDTALLRYWQDTQAEMSQYAIQLLQTAVGYEPRQPEAYHYAQLGLRVIGSRGLAKLAAQFGMRPGQKQMTEALEATSFQFHRGFLCGLFDADGSVQGNQEKGVSVRLSQSHLGTLKAVQRMLARLGIIAVLYENRRPAGYRLLPNSARQPAPYACKAQHELVIANDNLHLFQEWVGFREPHKAQKLEALLNGYKRQLNRERFAVTVAALEADGVEPVYDCTVPGPACFDANGFVVHNCGEIIGHTFHCNLAEIHLNRLDPHNRQEQEEAFTAGALTVAALLHHRFVEPRFQRSREWDPIVGVSFTGLFDFCVKAFGVEWLRWWQEGRPDTPIGKEFKQQEREYLSRWKEIVHRVVWDYCDRHSLRRPNRCTTVQPAGTKSLLTNASPGWHPPKAQRYIRRITFAKNDPVALACLDYGYSVVPAQADKDENGNLLNDPFDPRCTEWLVELPVEVEWANLPGAGQIEIEQFSALAQFDFYMQVQKYYTTHNTSATIELREDEVEALGSRIYEAIRDDEGYISAALLARFDAPFPRLPFEKIDKPTYERLVAEVKKRRRTDNFFAALARYGRNFTLAAEGPAGCDALGCLLPDSAPQS

SEQ ID NO: 615 - protein, 591 aa, Synechococcus species JA-3-3Ab
  Ssp-JA3 DnaB precursor
MISDYDLTGGDRLPPQNIEAEEEILGGILLDPEAMARVAELLRPEMFYLSAHQEIYRAALQLYSQGQPTDLTTVSAWLADHQLLERVGGTAAIRRLVEQTVSSVNIDQYARLVVDKYMRRRLIQVSNTLARLAYDTSQPLPQLLDRAEQEVFSLTQERVQRSLVPASEVLVNIFSELEERFQSGAQIPGIPTKFIDLDNLTQGLQRSDLVILAGRPSMGKTSLALNIAQNVAAYVKQPVAIFSLEMSREQLVQRLLASEARIDSSRLRSGRISENEWQRLGQAIGFLSQLPLFIDDTPNCTVTEIRSKARRLQVEQGGTLGLVLIDYLQLIQGSESDNRVQELSRITRGLKALAKELMVPVLVLSQLSRAVESRSDKRPQLADLRESGCLAGDTRVRDVDRGKIWRLEQLAALPPSAELPRLLSLNGRGRLVPQQPVRVFCSGRQPTCLLKTRLNFSIRATGNHPFLTRDGWKTLDELQLEEEVAVVVQEGLIWDPVVFISEPGEPQPVYDIEMPRHHNFVANGLLVHNSIEQDADVVMMIYRPEYYDPNTSDRGIAEVIVAKHRNGPTGTVRLLFESQYTQFRNLADPYR

SEQ ID NO: 616 - protein, 1155 aa, Synechococcus species JA-3-3Ab
  Ssp-JA3 RIR1 precursor
MVQSKEAHSPAIQGLGMGSLGEFPATAPAAAPVFYRTYSRRRPDSSRETWSDVCDRTLADIARLGRFTPQERELVERLQRQLKALISGRALWVMGTDWIQKPENYSGAYNCTSLTVVDWRSFGLMMDLAMMGCGTGAVLEPQFINRLPPILNRLQVQVVGSIGATPRHSRQEHTPIQRQGSRVHIQVGDSRRGWVESYQALLELAADPSFGGQVEVTVDLSHVRPAGERLKGFGGVANPIKLPGLYQRCAAILNKAVGRQLNSVECCLLIDEAAATVVAGNIRRSAGMRQFAADDELGSSAKDNLWQQDEQGNWRIDPERDALRMANHTRVFHRKPTREECIAAVRKQFYSGEGAIQWAGEAVARANADLINTPELKREFLNVYASEGPEGARRWIEERQAASSSPSVQPPTWHRVQRYGLNPCVTADTWIHTGDGPRQVKDLIGKQHSTYVNGELFSTTPEGFFYSGTKPVLKLVTQEGFSLRLTGNHRVLKVIAQTPKAQYTEWVPAEELRPGDRILLHNHRDLTPWDGEGTWEEGWLLGNLLGDGSLATTQGNDTAVLRYGQDTQQERSLHAAQVLQAAVGYEPRRPETCYHPKLKCWVIHSTGLARLAAKFGMAPGQKQMTAALEATSFDFHRGFLCGLFDADGSVQGGQEKGVSVRLSQSNLDTLKAVQRMLARLGIVSAIYENRRPAGYRLLPDSKRQPAPYACKVQHELVISGDNLHQFQAVVGFREPRKAQKLGELLGSYQRRLNREWFTVTVAALEPDGVEPVYDCTVPGPSCFDANGLVVHNCGEIIGCDFHCNLAEIHLNRLDPHNRQEQEEAFTAGALSAAALLHHRFVEPRFQRSREWDPIVGVSFTGLFDFCVKAFGVDWLRWWQEGRPDTPLGREFKQQEREYLSFWKEVVHRVVWDYCDRHGLRRPNRCTTVQPAGTKSLLTNASPGWHPPKAQRYIRRITFAKNDPVALACLDYGYSVVPAQSDKDENGNLLNDPFDPRCTEWLVELPVEVEWANLPGAEEIEIERFSALAQFDFYMQVQKYYTTHNTSATLELREDEIEALGSRIYEAIRDDEGYISAALLARFDAPFPRLPFEKIDKATYERLMAEVKQRRKVDNFYEALARYDRNLALTAEGPAGCDALGCLMPEASPQGENLSR

SEQ ID NO: 617 - protein, 1004 aa, Staphylococcus phage Twort
  StP-Twort ORF6 precursor
MKLRIKNLFTYVEFEEDDKYLKDIFLKRVHKTIGARQQGFQFSPAYKRGSWDGYIDFYVYEEDKFPTGLLHRVELLLGELQSRYNFQYSKIDERSESFLAPEDIDKEIKLLDNKIGQITLREYQYQAVYESLVNFNGVLKIATNGGKCISMDSMILTTEGYKSLQEIFETQGVKVDNKEKVIELKYPLINRYGDVEYTSHFTKNGEKPTKRIKTNKGIELVNTYNHPLLVREGFNLIWKKSEDIEVGDILVSRVGDHQFGNNNTVENEEEAYALGCMVADSYLGSYSRLSFSNDKKEILDKVSKFWNTFSNKEVYYDTYKESKGITIHLHDTNKTKEFHDKYKIEYGVAKDKKIPKCIMESPENIQLAFVSGYLECESSISEKNLEVTSASKDLLKDLQLILSNIGIVSTNKEKVVKKYKHNKYYRLIVNRKELIKLLPLLRFETQQRKNQKENFLSNNTKIKSSYGNTIEGSRYLLKKYRDSLNIDKKEFSKYLSRDTITIDRLREVISLYPDGDKEIRELFENVVNNNIYYQKVEQVLEGEIIPTFDVCMPKTHSFIANTIVNHNTECASGIIDQLLPQLEKGETIAFFTGSTEIFHQSADRLKERLNIPIGKIGAGKFDVKQVNVVMIPTLNSNMKDPTEGLKVTPKQNISKKIAKEVLPKFEGGKNQKRFMGMYLKQFEPKTKVDQKVKDELINIYNTSKSDQELLLNLRKHNVIFQNIAKSKNEKKYNKYHQMREFLDSVAVMIVDEAHHSKSDSWYNNLMTCDNALYRIALTGSIDTQDDLLNMRLEALFGEVISRVSNEFLISEGHSAKPTINTIPIMTPKDIENQKEYRDVYDEGITNNEFRNKLIAKLTEKWYNKDKGVLIIVNFITHGENISKLLEELGIEHFFLHGEVDSELRQQKLNDMRSGKLKVMIATSLIDEGVDISGIHALILGAGGKSLRQVLQRIGRALRKKKDDNTTQIFDFEDRTHKFLYEHFKQRLSIYEEEKFEVKDVTRKG

SEQ ID NO: 618 - protein, 505 aa, Saccharomyces unisporus, strain CBS 398
  Sun VMA precursor
ISQSLSKYSNSDTIIYVGCFEKGTEVLMADGTDKVIEDITIGEQVMGKDGQPREVVGLPRGKMTMYQVCHKATEQNEIALMDYVCSGNHKFVLVTPQNVKITEHMLRGKMYTSVNYFVANDFENGQVVKLRTKTFQHDIHGGADGAKVEAQKFASTIDLSPISWEIEASKYVELDVNVRNATTQLINPVFYESGKLASRLQTKNIDQTSADKLAYVMGSWVGAGSMDQPTFAGNQLDEEFVSRLTEYGSGLDLTKNNSVWDIINESGLRTLNANGEATKTIPKELVSDSISVREHFIAGLVDTQGNVKRASTGAVETASISTVYERISNDLVKLARSLGIKASVSQQEEHVDAKGVDQQQTYNIKLTGSALNGVVRLSALSKNRDEPVSFERLPVPFHFTLLEKAEDNYYGVTLPDATDKQYLLSSLALVHNCGERGNEMAEVLMEFPELFTEINGRKEPIMIRTTLVANTSNMPVAAREASIYTGITLAEYFRDQGKDVSMIAD

SEQ ID NO: 619 - protein, 763 aa, Thermoplasma acidophilum, ATCC 25905
  Tac-ATCC25905 VMA precursor
MGKIIRISGPVVVAEDVEDAKMYDVVKVGEMGLIGEIIKIEGNRSTIQVYEDTAGIRPDEKVENTRRPLSVELGPGILKSIYDGIQRPLDVIKITSGDFIARGLNPPALDRQKKWEFVPAVKKGETVFPGQILGTVQETSLITHRIMVPEGISGKVTMIADGEHRVEDVIATVSGNGKSYDIQMMTTWPVRKARRVQRKLLSRDPLVTAQSGNRCAFPVAEAANCRVPGPFGSGKCVSGDTPVLLDAGERRIGDLFMEAIRPKERGEIGQNEEIVRLHDSWRIYSMVGSEIVETVSHAIYHGKSNAIVNVRTENGREVRVTPVHKLFVKIGNSVIERPASEVNEGDEIAWPSVSENGDSQTVTTTLVLTFDRVVSKEMHSGVFDVYDLMVPDYGYNFIGGNGLIVLHNTVIQHQLAKWSDANIVVYIGCGERGNEMTEILTTFPELKDPNTGQPLMTGLSFIANTSNMPVAAREASIYTGITIAEYYRDMGYDVALMADSTSRWAEALREISGRLEEMPGEEGYPAYLGRRVSEFYERSGRARLVSPDERYGSITVIGAVSPPGGDISEPVSQNTLRVTRVFWALDAALANRRHFPSINWLNSYSLYTEDLRSWYDKNVSSEWSALRERAMEILQRESELQEVAQLVGYDAMPEKEKSILDVARIIREDFLQQSAFDEIDAYCSLKKQYLMLKAIMEIDTYQNKALDSGATMDNLASLAVREKLSRMKIVPEAQVESYYNDLVEEIHKEYGNFIGEKNAEASL

SEQ ID NO: 620 - protein, 764 aa, Thermoplasma acidophilum, DSM1728
  Tac-DSM1728 VMA precursor
MGKIIRISGPVVVAEDVEDAKMYDVVKVGEMGLIGEIIKIEGNRSTIQVYEDTAGIRPDEKVENTRRPLSVELGPGILKSIYDGIQRPLDVIKITSGDFIARGLNPPALDRQKKWEFVPAVKKGETVFPGQILGTVQETSLITHRIMVPEGISGKVTMIADGEHRVEDVIATVSGNGKSYDIQMMTTWPVRKARRVQRKLPPEIPLVTGQRVIDALFPVAKGGTAAVPGPFGSGKCVSGDTPVLLDAGERRIGDLFMEAIQDQKNAVEIGQNEEIVRLHDPLRIYSMVGSEIVESVSHAIYHGKSNAIVTVRTENGREVRVTPVHKLFVKIGNSVIERPASEVNEGDEIACASVSENGDSQTVTTTLVLTFDRVVSKEMHSGVFDVYDLMVPDYGYNFIGGNGLIVLHNTVIQHQLAKWSDANIVVYIGCGERGNEMTEILTTFPELKDPNTGQPLMDRTVLIANTSNMPVAAREASIYTGITIAEYYRDMGYDVALMADSTSRWAEALREISGRLEEMPGEEGYPAYLGRRVSEFYERSGRARLVSPDERYGSITVIGAVSPPGGDISEPVSQNTLRVTRVFWALDAALANRRHFPSINWLNSYSLYTEDLRSWYDKNVSSEWSALRERAMEILQRESELQEVAQLVGYDAMPEKEKSILDVARIIREDFLQQSAFDEIDAYCSLKKQYLMLKAIMEIDTYQNKALDSGATMDNLASLAVREKLSRMKIVPEAQVESYYNDLVEEIHKEYGNFIGEKNAEASL

SEQ ID NO: 621 - protein, 1829 aa, Thermococcus aggregans
  Tag Pol-1 (Tsp-TY Pol-1) precursor
MILDTDYITKDGKPIIRIFKKENGEFKIELDPHFQPYIYALLKDDSAIDEIKAIKGERHGKIVRVVDAVKVKKKFLGRDVEVWKLIFEHPQDVPALRGKIREHPAVIDIYEYDIPFAKRYLIDKGLIPMEGDEELKLMAFDIETFYHEGDEFGKGEIIMISYADEEEARVITWKNIDLPYVDVVSNEREMIKRFVQIVREKDPDVLITYNGDNFDLPYLIKRAEKLGVTLLLGRDKEHPEPKIHRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYRRRLRTTYLGGYVKEPERGLWENIAYLDFRCHPADTKVIVKGKGIVNISDVKEGDYILGIDGWQRVKKVWKYHYEGKLININGLKCTPNHKVPVVTENDRQTRIRDSLAKSFLSGKVKGKIITTKLFEKIAEFEKNKPSEEEILKGELSGIILAEGTLLRKDIEYFDSSRGKKRISHQYRVEITIGENEKELLERILYIFDKLFGIRPSVKKKGDTNALKITTAKKAVYLQIEELLKNIESLYAPAVLRGFFERDATVNKIRSTIVVTQGTNNKWKIDIVAKLLDSLGIPYSRYEYKYIENGKELTKHILEITGRDGLILFQTLVGFISSEKNEALEKAIEVREMNRLKNNSFYNLSTFEVSSEYYKGEVYDLTLEGNPYYFANGILTHNSLYPSIIVTHNVSPDTLEREGCKNYDVAPIVGYKFCKDFPGFIPSILGELITMRQEIKKKMKATIDPIEKKMLDYRQRAVKLLANSILPNEWLPIIENGEVKFVKIGEFIDRYMEEQKDKVRTVDNTEVLEVDNIFAFSLNKESKKSEIKKVKALIRHKYKGEAYEVELNSGRKIHITRGHSLFTIRNGKIKEIWGEEVKVGDLIIVPKKVKLNEKEAVINIPELISKLPDEDTADVVMTTPVKGRKNFFKGMLRTLKWIFGEESKRIRTFNRYLFHLEELGFVKLLPRGYEVTDWEGLKRYRQLYEKLVKNLRYNGNKREYLVRFNDIKDSVSCFPRKELEEWKIGTAKGFRAKCILKVDEDFGKFLGYYVSEGYAGAQKNKTGGMSYSVKLYNENPNVLKDMKNIAEKFFGKVRVGKNCVDIPKKMAYLLAKSLCGVTAENKRIPSIIFDSSEPVRWAFLRAYFVGDGDIHPSKRLRLSTKSELLANQLVFLLNSLGVSSIKIGFDSGVYRVYINEDLPFLQTSRQKNTYYPNLIPKEVLEEIFGRKFQKNITFEKFKELADSGKLDKRKVKLLDFLLNGDIVLDRVKNVEKREYEGYVYDLSVEDNENFLVGFGLLYAHNSYYGYMGYPKARWYSKECAESVTAWGRHYIEMTIKEIEEKFGFKVLYADSVTGDTEIIVKRNGRIEFVPIEKLFERVDYRIGEKEYCILEDVEALTLDNRGKLIWKKVPYVMRHRAKKKVYRIWITNSWYIDVTEDHSLIVAEDGLKEARPMEIEGKSLIATKDDLSGVEYIKPHAIEEISYNGYVYDIEVEGTHRFFANGILVHNTDGFYATIPGEKPETIKKKAKEFLKYINSKLPGLLELEYEGFYLRGFFVAKKRYAVIDEEGRITTRGLEVVRRDWSEIAKETQAKVLEAILKEDSVEKAVEIVKDVVEEIAKYQVPLEKLVIHEQITKDLSEYKAIGPHVAIAKRLAAKGIKVRPGTIISYIVLRGSGKISDRVILLSEYDPKKHKYDPDYYIENQVLPAVLRILEAFGYRKEDLKYQSSKQVGLDAWLKK

SEQ ID NO: 622 - protein, 1829 aa, Thermococcus aggregans; identical to SEQ ID NO: 621
  Tag Pol-2 (Tsp-TY Pol-2) precursor

SEQ ID NO: 623 - protein, 2605 aa, Trichodesmium erythraeum IMS101
  Ter DnaB-1 precursor
MQSDRLPPQNIESEEAILGGILLDPEAINRVTELLHPEFFAIQAHQIIYKAMCQLYSQGKPTDLMTVTSWLSDHNQLEKIGGRVKIVQLLERTVSAVNIDQYAALVLDKYIRRKLIQAGNEIFDLGFQTATKLEIILDQAEQKIFALTQDKPQQDLVPISETLINTFQEIEDRNEGVALPGLPCGFYDLDAMTGGFQRSDLIIVAGRPSMGKCAAYDTLVLQKDGSLVTLAEVYKRQEIELLTLGKNSKFYLTKPSAFIDDGIKPIFRVTTKLGRFVETTITHPFLTVNGWKPLSKLQVGEKIAVPRRLNIFGNETISESKFSSLINFDNLYLFPLVFQLERSQLALFIRYLFSLDGWVKIYQNKIVCFGYSTVSEKLIRQIQHILLRFGIVSGIEKFEEKRTEKIKVVKEVKSQRSHREEFTFATYRNCYCDGKWHLTITDALSQKNLMEDIGGFDSKNFYLFDLLQPHNSGNQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTTKRNSPKNSENLTTTETICRKNILANMENLPSDNQNFDSEKLDLPQPHNSGTQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGTQELENSDIFWDKIVSIEPVGEKQVYDLTVPETHNFVANDICLHNTSFAVNIAHSIAANLKLPIAIFSLEMSKEQLVLRLLASEARIESNRLRAGRISQNEWEPLTSAITNLSEMPIFIDDTPNITVNEIRSKTRQLQSEQGGKLGLILLDYLQLMEGNNSDNRVLELARITRNLKGLARELSVPIIALSQLSRSVEARTNKRPMMSDLRESGCLTGESLICLADGKKIPISCLVGNSNFAVLALNENTWKFESAMVSRVFSTGVKPIFSLQTSSGKLIRATANHPFFSMGGWKQLNTLNIGDSLAILNQKMLKCSILYDGHFLSQSDFGPKYGRNLGSIVKSHEWEKSTEIDVEWDEIVEIMPHGEAEVFDLTVPGLHNFVANEIVVHNSIEQDADLVIMLYRDEYYSPDTPDQGIAEVIITKHRNGPTGTVKLLFDPQFTKFRNLAVDKR

SEQ ID NO: 624 - protein, 2684 aa, Trichodesmium erythraeum IMS101
  Ter DnaE-1 precursor
MSFVGLHIHSDYSLLDGASQLPQLIDRAVELGMPAIALTDHGVMYGAIQLIKLCRNKNIKPIIGNEMYVIKGDIEKQQRGKKFHQVVLAKNTQGYKNLVKLTTLSHLHGFQGKGIFARPCINKELLEKYHEGLIVTSGCLAGEVPQNIMRGELEEAKKIAKWYKDLFGEDYYLEIQDHGFQEDRVVNTGIVTIAKKLKIKIVATNDSHFISCRDVEAHDALLCINTQKLIAEEKRMRYSGTEYLKSAEEMKQLFRDHLENEVIEEAIANTLEVANKVKAYEGILGEPRIPDYPIPPDHNADTYLEKLAWSGLLERLKLKQKSEISPIYKERMETELKVLQDKGFSTYFLVVWDYIKYARDNNIPVGPGRGSAAGSLVAYSLRITNIDPVHHGLLFERFLNPERKSMPDIDTDFCIENRDVMIKYVTQRYGEERVAQIITFNRMTSKAVLKDVGRVLGISFGEANKMAKLIPVARGKPAKLKVMISDETPSPEFKKAYDNQETPIEDNKAGKISTISVRQWIDMAIRIEGTNKTFGVHAAGVVISKEPLDEIVPLQRNNDGSVITQYHMEDIESLGLLKMDFLGLKNLTIIQNTAELIKKNHHLPLVPDDLPANERKAIEILAKGNTKKMPEDVKKTYDLIKSGDLEGVFQLESSGMVDVVKKLKPTSIEDISSILALYRPGPLDAGLIPKFIDRKHGSEKIEYQHPKLEPILKETYGVLCLPKGTLIDQPDGSREAIENIKSGEVILTSDGRKVWEAKVAKQWRSGVREILKITLSSGTVIYSGKNHRFLTPEGDKFAWELQPQVGRVKNALIYGSAVYEKWQVSSNQKQLRKNDAYLLGLLVGKSNLISSTPNVSFSTQGAITWGKNLIDETWGGEAKHYFDTSRRQVYLNFNTQSKPTALTEFLDGIYGAQNWQVESVAKHLPEDILDYSEKDRIDLLRGLWDSGGFDGKKLLYYPGSSPQLLSQVCQLLGSLKIDYYLADNSVRISDRSRFIDILENYQMSSQQKEEISESYLPASSWFLKGGSENNIQKTDSSSRKTGEASQQKATLFTQNLFSAQTPAENWEKVGENHLLSSWFLTDASENNIQKTDSSSRKTGEASQQKATLFTQNLFSAQTPAENWEKVRENHLLSSWFLTNASEIYLQRIDSSSRKTGEASQQKATLFTQNLFSVQTPAENWEKVRENHLLSSWFLTDASENNIQKTDSSSRKTGEASQQKATLFTQNLFSAQTPAENWEKVRENHLLSSWFLTNASENNIQKTDSSSRKTGEASQQKATLFTQNLFSAQTPAENWKKSRKNHLPSSWFLKGGSENNIQKTDSSSRKTGEASQQKATLFTQNLFSAQTPAENWEKVRENHLLSSWFLKDASENNIQKTDSSSRKTGEASQQKATLFTQNLFSAQTPAENWEKVRENHLLSSWFLTDASENNIQKTDSSSRKTGEASQQKATLFTQNLFSAQTPAENWEKVRENHLLSSWFLTDASENNIQKTDSSSRKTGEASQQKATLFTQNLFSAQTPAENWEKVRENHLLSSWFLTNASENNIQKTDSSSRKTGEASQQKATLFTQNLFSAQTPAENWKKARENHLLSSWFLTNASEIYLQRTDSSSRKTGEASQQKATLFTQNLFSVQTPAENWKKARENHLLSSWFLTNASEIYLQRTDSSSRKTGGASQQKATLFNQNLFSVQTPAENWEKVRENYLLSSWFLTNASEIYLQRTDSSSRKTGEASQQKATLFTQNLFSVQTPAENWKKARENHLLSSWFLTNASEIYLQRTDSSSRKTGGASQQKATLFNQNLFSVQTPAENWKKARENHLLSSWFLTNASEIYLQRTDSSSRKTVEASQQKATLFTQNLFSAQTPAENWEKVRENYLLSSWFLTNASEIYLQRIDSSSRKTGEACQQKATLFNQNLFSAQTPAENWKKVRENHLLSSWFLTDASENNIQKTDSSSRKTVEASQQKATLFTQNLFSAQTPAENWKKSRKNHLPSSWFLTDASENNIQKTDSSSRKTGEASQQKATLFTQNLFSVQTPELENWECEKTYLQDVRVVHVVSVEEVGEAECFDLEMEDQSSPYFLAEGVVVHNCYQEQIMKMAQDLAGYSLGEADLLRRCLSGSTKVIDAATGNLFSLKEIAAQPEYWLSRKVFSLDLKSQQVVQQPITEIHPNGVRDVWQITTRTNRKVCATDDHLFYTVLGWKPLKDFSVGDRLGLPNKIPINYRSQISDSKVKFTAYLIGEGYLYTNSFSCSYFCNSDGELIADFYGCAEELFGSSAPIEKQLHLGNKSVIYVRIGLISGLKNWVDSYLQCANSRVQEIPNWIFSLSQSQLQLFLGILWSTSGIFDETIGYTYYSSNSEVLVRQVQHLFLRLGIVSLFNVNKVKGQGELDVSYVVEVRGREDMLKFYKLIKPYLSSYKQGLCESCYLVIKYQQSYQFKYFLTPDFFDLIVKAKKASSMTRALGVCGGEISSVWNFQNTSNRSLSFDKFNNFSTVLADEELTAIANSDVFWDEIISIEYIGKEEVFDLTIPETHNFIANDFIVHNCMGKKKVSEMEKHREKFIDGAAQRGVSSVVAKDLFEQMIKFAEYCLTYETEIMTVEYGPLPIGKIVEYRIECTVYTVDKNGYIYTQPIAQWHNRGMQEVYEYSLEDGTVIRATPEHKFMTEDGQMLPIDEIFERNLDLKCLGTLEL

SEQ ID NO: 625 - protein, 891 aa, Trichodesmium erythraeum IMS101
  Ter GyrB precursor
MASNNYGAEQIQVLEGLEAVRKRPGMYIGTTGPRGLHHLVYEVVDNSIDEALAGYCTHIEVDLNKDGSVKVTDDGRGIPVDTHSKTGKSALETVMTVLHAGGKFGGGGYKVSGGLHGVGVSVVNALSEWVEVTVWRDKKTHIQGYERGQPTGDLKSKPNKEKRTGTSVQFLPDQEIFTTGIQFDYNTIIGRLRELAYLNAGVKITITDNRLELVKSDEPKVESYCYEGGIKEYVTYMNREKQSLHEEVIFVRGEKNDVQVEVALQWCIDAFSDNVLGFANNIRTIDGGTHLEGLKTVLTRTMNGIARKRNKLKDSDPNLGGENVREGLTAVISVKVPEPEFEGQTKTKLGNTEVRGIVDSLVGEVLSEYLDFNPQVADAVLDKAIQAFKAAEAARRARDLVRRKSVLESSPLPGKLADCSTKNPEESEIYLVEGDSASGCFAGNQKVILADGRRLSFAEIVAEQAEGKEHFCYTINQSGNVAIERIINARITKKNASVIKIILDNNETIICTPDHLFMLRDGSYKPAALLTGNDSLMPLSQKSSQKTENSQELDGYEMVWSPQKESWIYTHLLPDFYNLKAGVYQSANGDSCYHVGFKKLNSTKTEGLLTEKHLEFHKTNLELAYRCSERDEFLARDIIPNYNDHYNYRVVSIEPLEERLDVYDIEVPNTHNFALASGVFVHNSAKQGRDRRFQAILPLRGKIINIEKTDDAKIYKNNEIQSMITALGLGIKGDEFDASQLRYHKVIIMTDADVDGSHIRTLLLTFFYRYQRALVDQGYIYIACPPLYKVERGRNHYYCYSDRELNELIQNEFPDNANYTIQRFKGLGEMMPVQLWDTTMNPETRTLKRVEIEDAAEADRIFTVLMGDRVAPRREFIETYGPKLKITDLDI

SEQ ID NO: 626 - protein, 1080 aa, Trichodesmium erythraeum IMS101
  Ter Ndse-1 precursor
MRILVTGGAGFLGSHLIDRLIEQGHEVLCLDNFYTGNKHNIYNWLNNPSFELIRHDITEPIRLEVDQIYHLACPASPIHYQYNPVKTIKTNVMGTLNMLGLAKRVKAKFFLASTSEVYGDPDVHPQTEEYRGNVNCIGIRSCFDSKTEILTEAGWVAFPNLQSEVKVATLNSEGKVEYHIPEEYIVQSYIGEMYRFANTNFDFCVTPNHWMYVRNKTGNLEFIRADEAKLWQSLEVLTGGDFEGEKEEWLELRKSPINSHRKVEKIFMDDWLEFLGYYISEGRVDVKKSLRVVGGNDAYVADYNILIGQENSELALKIASCLRRLGFNFSEILFDSDKHQFRVCSKQLAEMLLPLGKSGEKYIPRELLKLSKRQLLILFKALIMGDNSEQKNHYTYYSKSKRLADDIQELALRCGYAATVVSHAVGRDLYQVNIRPAEDANLVVPERFHYVGKVYCVNVTNHVVFVRRNGRAAWCGQCYDEGKRVAETLAFDYHRQNNVDIRVARIFNSLTGDQKVLYYIAKKLYYETFAECYDRINGDISSVSVPCFDENYQTVIKPISAIWKHHVKKKGFKIKITWGKQIKITEDHSLFTRNENNKPQAVFGNEIKVGDEIGIPSYISFLEQPLEPFHITDKILIQEEIYVESEDTISYIEKYGDKMREYLLAKSLSPSQFYSILKTYEAKNQIPWHLWKYLELPLSEKDKVCYLSKKAIKNWIDNVEELLWFLGFYVARGSLIKNEVVLKGEPSQLEKVIELIERIFEYKSEINDSGYISIKSKILVDLIGYGLNFGNQEKDIPNWILQLPEQQLIRFLKGFVAGNNLENQLNFYLEFKTDSQLVAEKLVLILSKFGLVADVSEIEVNEEDIAKIYRIIIEGLEDKNIHNLSKVEQKISALTTGDIAWGKIESIEEFEIDDYVYDFSVPNYENFIGGSYNVFAHNTYGPRMLENDGRVVSNFIVQALKGIPLTVYGDGSQTRSFCYVSDLIEGFIRLMNQDFIGPVNLGNPREYTILELAQKIQTMVNPGTEIIYKPLPQDDPKQRQPDITRGKKYLGWEPTVFLEEGLKLTIEDFRERLKNELPKN

SEQ ID NO: 627 - protein, 1080 aa, Trichodesmium erythraeum IMS101; identical to SEQ ID NO: 626
  Ter Ndse-2 precursor

SEQ ID NO: 628 - protein, 1531 aa, Trichodesmium erythraeum IMS101
  Ter Snf2 precursor
MAILHSFWVTEHEQPSFLFIWGEAWHRVTEEDAGEVEKITNNPYSITLDELLKLSEANIYLSLEKHKKSTNQTLGIPTKLSESNQKLYPIHSAISLSEIPENLYIYPWKIEGICLEPDEAIKFLQSIPLGQTTESFIGSDLKFWSHLARWSLDLLARCKFLPSIEQRSITQEFITTWQPLIDSSIDQTRLKNFAQQMPLVCRTYNLDWQLHPSLESLQIITKNNSYSNLPRLQSSQEIIQDFLKNTIDKQIRQLSAEISLTETTSLNSSIRQWLKSLSGKLSLKLPAPQETKKIQKILDNWKSPLQEYQAIENKFVACFCLHSPSNNSQQWKLEYCLQGLDNPDFLVDAKTIWENPVASLNYQGKTIKLPQETLLKGLGLASRIYPIIEPSLQEATPQYCLLTSQQAYDFIKSGSGRFIDSGLGVILPPSLANREGWASRLGLSIQATAPKMKKTEKLGLKSLLNFKWQLSIGGHKLTKAEFEKLVSQDSPLVEVNGEWVELQGQDVRAAKNFFASRKDQMSLSLEDALRLATGDTQTVEKLPVVNFEAGGQFQELLDTLTNNRSLEEVSTPENFRGELRNYQARGVSWLSFLERWGLGACLADDMGLGKCVLHDTEIYVNGMVMEAEQIWQAYAGEAEFDGEGFWTEPNKELLVNSLDETTGKIVFARIRRLYRQWVREKLRKVRLKDGSSITITCRHKLFIRDSWKNDFQVGDDVCVPAKLMWDGKPEDPDVVKFVAWQVAEGWERVNSGMFGVSQKGKDVLEGLLEVFSRLGKRYDIKINCPKVVAHGSKKNCYEFSAHSLEYRKFLEEKRYGWGKRSHEKTIPLFIMQADLDSVRVFLSNYFDAEGWVNKTVRCVEISTASSQLIQELSILLRRFGVWMKISPQQKCATNGTGVFCTYYIGTFGGNSARCFLQEIGFNDSGKQENLKSICEKIADSNVEGIPASDIVAELVEKTQLPVGSLGIQDPIYMDGCQDFSPTSLEKVINSIEDIISGAGEEEYGQLKSSKLRNKTLEAYSLLNILELEIYKTRLQKLLNQEVYYCQIESIEEMEYEGWVYDFEVSKYHNFVANNIICHNTIQTIAFLLKQQEQKALKGPTLLVCPTSVLGNWEREVKKFGPTLKAIVHHGDKRAKGKGFATAVKDTNLVITSYALLHRDEKILETIKWQSVIVDEAQNIKNPEAKQSQAARKLDASFRIALTGTPVENRLSELWSILDFLNPGYLGQKQFFQRRFAIPIEKYGDTSSLQILRSLVQPFILRRLKTDKDIIQDLPEKQENTIFCPLANEQALLYQNIVENSLAEIDTVGGIQRKGKILALLIKLKQLCNHPVLLQIKKGSRKKVEITDKNSGKLQRLGAMLEEIISEEERAIIFTQFAEWGKVLQPYLQKSLGREVSFLYGSTQRSKREEMIDQFQLDPQGPPVMILSLKAGGTGLNLTRANHVFHFDRWWNPAVENQATDRVFRIGQTRNVQVHKFVCTGTLEEKIHDLIESKKELAEQVVGAGEKWLTELDTDQLRNLLILDRNQVIKEE

SEQ ID NO: 629 - protein, 458 aa, Trichodesmium erythraeum IMS101
  Ter ThyX precursor
MQQARTHRIGCCLSGNTKVRFRYSSSSQEAKYYEETIEKLANLWHYGSKNQYTSKDAKCMQENISSRNIFTLDTQTNQIVSSKITNIYINGEKETYTIKTVSGKEIRATLEHQFWTNQGWKRLKDFNNSTQLCEVQLAGNKVTPQEVKFLEKEMFNEKWIPVRNYDGYKIYSLDILNSYLIQKENKEHSRSKSKNCLLPNLNYGIRYDRLSEVNINRLVMENLKLLGEYKELEVRHLNENSFNNKPKKFAWNSSKSDQIDNINNNSFSDNSGVFVEIESIEKFGKEITYDLEVEHPEHNFIANGLVVHNSFDVQSYRFCSGKVIAVADGKTDIETAFYLRPVGEYSDRKGKKYYYSAEQREKDLYWCLEAAKKYKLDMELGMSEEHARGKIPFDYRQHFVVSFNCRSLLHFLDLRFKKNAQLEIQKLCELMWPHFQDWVPNIAEWYEKNRLKKGKLAP

SEQ ID NO: 630 - protein, 1523 aa, Thermococcus fumicolans
  Tfu Pol-1 precursor
MILDTDYITEDGRPVIRVFKKENGEFKIEYDRDFEPYIYALLKDDSAIEDVKKITASRHGTTVRVVRAGKVKKKFLGRPIEVWKLYFTHPQDVPAIRDKIREHPAVVDIYEYDIPFAKRYLIDKGLIPMEGDEELKMLAFDIETLYHEGEEFAEGPILMISYADEEGARVITWKKIDLPYVDVVSTEKEMIKRFLKVVKEKDPDVLITYNGDNFDFAYLKKRSEKLGVKFILGRDGSEPKIQRMGDRFAVEVKGRIHFDLYPVIRHTINLPTYTLEAVYEAIFGQPKEKVYAEEIAQAWETGEGLERVARYSMEDAKVTYELGREFFPMEAQLSRLVGQSFWDVSRSSTGNLVEWYLLRKAYERNELAPNKPSGRELERRRGGYAGGYVKEPERGLWENIAYLDFRCHPADTKVIVKGKGVVNISEVREGDYVLGIDGWQKVQRVWEYDYEGELVNINGLKCTPNHKLPVVRRTERQTAIRDSLAKSFLTKKVKGKLITTPLFEKIGKIEREDVPEEEILKGELAGIILAEGTLLRKDVEYFDSSRGKKRVSHQYRVEITVGAQEEDFQRRIVYIFERLFGVTPSVYRKKNTNAITFKVAKKEVYLRVREIMDGIENLHAPSVLRGFFEGDGSVNKVRKTVVVNQGTNNEWKIEVVSKLLNKLGIPHRRYTYDYTEREKTMTTHILEIAGRDGLILFQTIVGFISTEKNMALEEAIRNREVNRLENNAFYTLADFTAKTEYYKGKVYDLTLEGTPYYFANGILTHNSLYPSIIISHNVSPDTLNREGCGEYDEAPQVGHRFCKDFPGFIPSLLGDLLDERQKVKKHMKATVDPIEKKLLDYRQRAIKILANSFYGYYGYAKARWYCKECAESVTAWGRQYIETTMREIEEKFGFKVLYADSVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVKLWELIGLLVGDGNWGGQSNWAKYYVGLSCGLDKAEIERKVLNPLREASVISNYYDKSKKGDVSILSKWLAGFMVKYFKDENGNKAIPSFMFNLPREYIEAFLRGLFSADGTVSLRRGIPEIRLTSVNRELSDAVRKLLWLVGVSNSLFTETKPNRYLEKESGTHSIHVRIKNKHRFADRIGFLIDRKSTKLSENLGGHTNKKRAYKYDFDLVYPRKIEEITYDGYVYDIEVEGTHRFFANGILVHNTDGFFATIPGADAETVKKKAREFLNYINPKLPGLLELEYEGFYRRGFFVTKKKYAVIDEEGKITTRGLEIVRRDWSEVAKETQARVLEAILRHGDVEEAVRIVKEVTEKLSKYEVPPEKLVIHEQITRELKDYKATGPHVAIAKRLAARGIKVRPGTVISYIVLKGSGRIGDRTIPFDEFDPTKHRYDAEYYIENQVLPAVERILKAFGYKKEDLRYQKTRQVGLGAWLKMGKK

SEQ ID NO: 631 - protein, 1523 aa, Thermococcus fumicolans; identical to SEQ ID NO: 630
  Tfu Pol-2 precursor

SEQ ID NO: 632 - protein, 659 aa, Thermobifida fusca YX
  Tfus Hyp-2914 precursor
MPKPERFVSRSDLGWGPSNASYANPKLGLVIHYDGSNQNLAAKDHSACINYWKNTRSFHTGPARGWADIGYCVDEETEILTTDGWKTFRETAPGDLALTLNHSTGLAEWQPILDVYVFPAQPRTMIRMEGRTHSSLTTPQHRWPVERATRTTAASEETRRERTWATTETLTDGDRIPQAAPCRDLPTEPKWSDALVELVAWLWLGDHATRSRHSATLALSQRDGLGAARIRAALHSLFGPPAPQPSRGGRRPWWRERLTRSCVEFHLSPGASRMLLEHIPDGAVSFGFLRSLTRAQLNLFIDTSVRACRAHGTTTASRTALVHRDRRRAEAFQFAAILAGYPASLRHRTLPGPAPADVWLVHLDTAQDFAPKAATPGLTIAEEPYTGRVWCVRTPNATWLARRAGTVYFTGNSFGACPHGYVFEGRGLYKSQAAQPGGNATYYSVTLMCGPSDTITDAQINAVRQLREWLMEPAMSIAGTVKGHRDFISTSCPGDTLYRMVRDGVFSKPARWGTTDTEEDEVPHYLNIAQTKEVVVPPKQYVSLRWDTVWTDTAKTAHKDGLAVISKPCDLNGALWLDIEGLAEGEDVQVHMADWERATKKYSLHPIAEGIGTEGRSFPVFPVVNRLGSGRTMDLRVYNVGEQPFTIRRATFKGHVWLR

SEQ ID NO: 633 - protein, 1177 aa, Thermobifida fusca YX
  Tfus RecA-1 precursor
MSLARRSVTPIMKKKASTQQGFPVAASDRDKALETALAQIERQFGKGTIMRLGDDNRPPIESIPTGSISLDVALGIGGIPRGRIVEIYGPESSGKCLTADTYVWTDRGLETVAEVFGRAGLPLSSTSRVTDVRDRDIRVVNEKGELEQVAALTHNGRQPVVRITVASGRQVTVTRNHPLRVMNDDGFIVWREAGQLREGDVLVSAAFGAVQAASGGGLSEDEAVLLGYLTAAGSLDPAGHVCFTTTDIETGAEFAALAEWLLDTTVTAVPGDGQVAYVLSDPAARHTLAERYGVDYAAAARIPQCVRTAGDKMQRAFLAALYTAAGWTDTSAAVGLRTASAPLAREVQYLLYGLGIPADLDRSHGNGQHPWAVTISPAAAPRFHTEVGFRTAQQSPQTGLHEPTPQVEAIPNLTGLIHALRDSIGDRAESTDDPFPAASGGAYDRDQVRRVIDWAKRRTDEAPATANAILGYLTQLTDARYTYEPITAVEDAGQQPTFDLMVPRTHSFLANGILSHNTTVALHAVANAQRAGGIAAFIDAEHALDPSYAEKIGVNIDDLLLSQPDTGEQALEIVDMLVRSGAISIIVIDSVAALVPRAEIEGEMGDSHVGLQARLMSQALRKIAGALNQTKTTAIFINQLREKVGVMFGCMHYDTLVTLADGTQEKIGTIVDRKLDVEVLSYDPETDRIVPRRVVNWFDNGAADHFLQFTVGRSGKPGGAQFTATPNHLIRTPGGWREAGELIAGDRVLVHEPHYLNEQQRQVVYGSLMGRGTLVPDRHGGPGVHFCMAHTAEQAAYLDWKVSLLGNIAHSRTAEASATVGVEFTPMPELSELHRVVDFGDGHTHLTWEFLKQLTPLALAVWYLDAGTLTIPQSGTDDDARVQIDVETLSPGSRQRLVEYLRDTHELDAAVVQQGADARSLLEFTPAATVRFLELVAPYVPESMSSMLLAQFRGRCSVTPEYSDPVQRLVAAPVLDIQVKPGSTRKFDIEVEGNHNYFVDGVMVHNSPETTSGGRALKFYASVRMDVRRIETLKDGTEAVGNRTRVKVVKNKLAPPFKQAEFDILYGVGISREGGLLDLGVEHGIVRKSGAWYTYEGTQLGQGKENARNFLRANPDMADEIEKRIKQKLGIPTGDDSAPAEEAAKDEAKAASTTKRTTRKTTASTSASKSAAPSTDA

SEQ ID NO: 634 - protein, 1177 aa, Thermobifida fusca YX; identical to SEQ ID NO: 633
  Tfus RecA-2 precursor

SEQ ID NO: 635 - protein, 547 aa, Torulaspora globosa, strain CBS 764
  Tgl VMA precursor
ISQSLSKYSNSDVIIYVGCFAKGTPVMMHDGSVKAIETINVGEEVMGADGLGRKIVGLPRGREVMYKVSQKTEHRAYETDETRSAPVGLFEYTCNATHKLVVRTPRSCRTLNRTMKGVEYYEVVFFDLAKEKLKDGREIEVVKEISRSYPVTEGPERAAEIMKEYQEAGAGKQFFEWTIEARDVGALGAHVRKATHQVYAPVLYESDFFFHYVKDSKFCLKSEAPFALAYLLGLWVGDGLSDRAVFSVDSEDTTLFDRIIDFADILDLSAEYKDREIPKRAKTVGLFPKTIRGNDIGRNLNTDNPLWNAIVDLGYLKGGVKHVPSYLLTDSIPHREVFLAGLIDSDGYVRGEEAPAATIKTIHKTVMEGTVAVARSLGLTVSVNIEEAKVDKDGVNHRPAYAIYISGGDALLSVLANCASAKKHRAAPTKEVVRGLNEVYFEMKELQEDDYYGITLSENSDHQFMLANQLVVHNCGERGNEMAEVLMEFPELYTEKNGKKEPIMKRTTLVANTSNMPVAAREASIYTGITLAEYFRDQGRDVSMIAD

SEQ ID NO: 636 - protein, 1668 aa, Thermococcus hydrothermalis
  Thy Pol-1 precursor
FEPYIYALLKDDSAIEEVKKITAGRHGRVVKVKRAEKVKKKFLGRPIEVWKLYFTHPQDVPAIRDEIRRHSAVVDIYEYDIPFAKRYLIDKGLIPMEGDEELKMMSFDIETLYHEGEEFGTGPILMISYADEGEARVITWKKIDLPYVEVVSTEKEMIKRFLKVVKEKDPDVLITYNGDNFDFAYLKKRCEKIGIKFTLRRDGSEPKIQRMGDRFAVEVKGRIHFDLYPVIRRTINLPTYTLEAVYEAVFGTPKEKVYPEEITTAWETGEGLERVARYSMEDAKVTYELGREFFPMEAQLSRLIGQSLWDVSRSSTGNLVEWFLLRKAYERNEIAPNKPDERELARRRGGYAGGYVKEPERGLWDNIVYLDFMSLYPSIIITHNVSPDTFNREGCKEYDTAPQVGHKFCKDVQGFIPSLLGALLDERQKIKKRMKASIDPLEKKLLDYRQKAIKILANSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRSVSYEKFRELVKSEKLDGEKAKRIEWLLNGDVVLDKVLEVKKRPYEGYVYDLSVEEDENFLAGFGLLYAHNSYYGYYGYARARWYCKECAESVTAWGRDYIETTIHEIEERFGFKVLYADSVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYNVGLSLGLDKEEIEEKILKPLKNTGIISNYYDKSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHNTDGFFATIPGADAETVKKKAKEFLKYINAKLPGLLELEYEGFYVRGFFVTKKKYAVIDEEGKITTRGLEIVRRDWSEIAKETQARVLEAILRHGDVEEAVRIVKDVTEKLSKYEVPPEKLVIHEQITRELKDYKATGPHVAIAKRLAARGIKIRPGTVISYIVLKGSGRIGDRAIPFDEFDPTKHRYDAEYYIENQVLPAVERILKAFGYKKEELRYQKTRQVGLGAWLKLKGKK

SEQ ID NO: 637 - protein, 1668 aa, Thermococcus hydrothermalis; identical to SEQ ID NO: 636
  Thy Pol-2 precursor

SEQ ID NO: 638 - protein, 1157 aa, Thermococcus kodakaraensis KOD1
  Tko CDC21-1 precursor
MDREEMIARFAKFLREYVDDEGNEVYINRLKDLLTVTPKRSLAIDWAHLNSFDPELADELLNNPEEAIASAEDAIQIVLREPPLLVEREFKVHARFYNLPKTLLVKELGSEHINKLIQVEGIITRVSEVKPFVEKAVFVCRDCGNEMVRLQRPYENLVKPAKCDACGSRNIELDVDKSRFLNFQSFRLQDRPESLKGGQMPRFVDAILLDDLVDAALPGDRVLVTGVLRVILEQREKRPIFKKILEVNHIEQLSKEIEELEISPEDEQKIRELAKRKDIVDAIVDSIAPAIWGHRIVKKGIALALFGGVQRTLPDGTKLRGESHVLLVGDPGVAKSQLLRYVANLAPRAIYTSGKSSSAAGLCVAPDSIIKTNLGQFKIGELVEKAIPEKVQDYKSVNAEKLGLYIKTLDGDMRVLRLWKLRAPEKLIRIEGDGLSITVTPETKLLTPNGWVEARNVDGEVVTENGPVKVSKQEIESPHDYVYDLTVEGSHSFIANGFVVHNTAAAVRDEFTGSWVLEAGVLVLADGGFALIDEFDKMSDRDRSAIHEALEQQSYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHNTISISKAGITATLNSRTTVIAAANPKFGRFNRHKSLPEQLDLPPTLLSRFDLIFLLLDEPDEKVDASIAEHILKVRRGEAEAVTPKIPYDLLKKYIAYARKNVHPVLSREAMEEIKRYYVKMRKGLRRGDEDGVQPIPITARQLEALIRLSEAHARMRLSETVTREDARAAIEIIEAMMKTIAVDEEGNLDVSILEVGKSSKKINKIEKLVDIIKSLESEGEFGAPEEKVIEAAKQAGIGTKADIEKLLNELKSDGRVYEPRAGFYRVI

SEQ ID NO: 639 - protein, 1157 aa, Thermococcus kodakaraensis KOD1; identical to SEQ ID NO: 638
  Tko CDC21-2 precursor

SEQ ID NO: 640 - protein, 1144 aa, Thermococcus kodakaraensis KOD1
  Tko IF2 precursor
MTKRIRQPIIAVLGHVDHGKCLLPDEKVILPEHGPITLKGLFDLAKETVVADNEKEIRKLGAKLTIVGEDGRLRVLESPYVWKVRHRGKMLRVKLKNWHSVSVTPEHPFLTTRGWVRADQLKPGDYVAVPRVIHGNESDERFVSFVYEKLKNDELIAKLRGEVLSKISSEFKGDRAYKVERNVFRWEDIERLNLWDEVERVAFTPRMHRSGKPLHYVKLPRSPEEWEAFFYFAGVMFGDGSQDKIANNDVEVYEELKKLSVLGVAVKRVERTTSYEIELTNGKNALLRLLRVLFEYPERQKAKSIRVPRILFIAPRKYVSRFLRGYFDADGHVSLKDARIEVTSASQEFLEDLSLLLLRFGIVSKIYRSDYTTLVISGRRNLDLFRRYIGFSVKNKAEALEKAIKKSRRSESYPIFEELKRLRLLFGFTRTELNSNVPFYGKYESEEAPSYETLMRILDAIEKGSINLDKKIAVLEGRIRDHNYIKAFEKDGLIKDGKLTELGRELLEVWRNREFDSSDVDYIRNLAENLVFIPVEDIEEFEYEGYVYDVTTETHNFVANGILVHNTTLLDRIRHTNVAGKEAGGITQHIGATEVPIDVVKQLAGPLIKLWKGEIKLPGLLFIDTPGHEAFTSLRARGGSLADLAVLVVDINEGFQPQTIESIEILRRYRTPFIVAANKIDRIKGWVIEEDEPFLVNIKKQDQRAIQELETKLWELIGKFYEMGFNANRFDRVQDFTRELAIVPISAKYGIGIPELLVLIAGLSQKYLEEKLKIEVEGPARGTILEVREEVGLGTTIDVIIYDGTLRKDDTIVVGGKDKAIVTKIRALLKPKPLDEIRDPRFRFDQVDEVTAAAGVKIAAPGLEEALAGSPVIAARSEEEIEKAKQEILSQIQSVVINTGKIGVIVKADTLGSLEALSKELQEKGIPIRKADVGNISKTDVMEALSVKEEEPKYGVVLGFNVKVNEDAEEVANAKGVPIFVGNIIYKLIEDYEAWVKEEEEKRKRELLKNVTFPGVIRLYPDERYVFRRSKPAIVGVEVLEGRIRPGVTLIKETGEKVGVIKSIKNKNDFVQEAKKGDAVAIAIEGAIVGRHIHPGETLYVDLSKNDVIILAKQLKDELEETDIKALKMTAKVKAKEDPFWRAV

SEQ ID NO: 641 - protein, 1198 aa, Thermococcus kodakaraensis KOD1
  Tko KlbA precursor
MFQDEKKKKESLSWIDEILSGEEDPLAGILKKDDKKEQPSKNKVSEELPVPSSGVGSLEDILSGSTSEKRESRPTSETGADLLSQLLGGEEKPQKSMKEKTAEREKREPLPQSKPEPASTIPSATGATGADFLSELLGGSSGSATSQPVQTSPSKPVSNARSIFSESLREESSYAGRAQVLDAYGNVRILKVKGEPVPIYEIRLPKLSREEEQLFRRIKDRAITEIQIDPTAIPDPEERRKVFMNAVKRMIKEEAPHYSEGRIEVLADMIVQQMIGYGKLDPLVRDDNLEEIMVIGTNRPVYVWHRRFNMCKTNVIFDSDRDILNIIERIAREVGRRIDQQSPLLDARLPDGSRVNATIPPISLDGPTITIRKFKRDPLTIIDLIKYGTMSSEVAAFLWVLVDGLGVKPANVLVAGGTGSGKTTTLNSLGMFIPPSERVISIEDTAELQLPVEHWVRLETRPPNLEGKGEVTMDDLVRNTLRMRPDRIIVGEVRGPEARTMFTAMNTGHNGALYDFSVIQLSNGKFVLIGDVVEELFNKYSDRIKTYKDLEYIELDPEDQFEVVSVGPNLKAGKHTVTAVWRRKVRNGEKLIRIRTRTGNEVILTKTHPFFVFSDGDVVRKEAEKVRPGDRVAVMMRPPKAPQSPAVVPVEVYAGISDYYLVPNGNGMKKVPNRGVPPEDAEYLLSRNSKPVKLVREVGTSLAYVAGVILGDGYLSSDGYNLSVTFDDPDYMNSFTSAMSEFLPESAPRIKDNGTSTVVTYGSRIFNEMLSRIFGIPRGKKSSIWDVPDVVLTNDDLMRYFIAGLFDADGSVDETGPAVILTTKSESAARKIWYALQRLGIISTVSRVRNRGFKEGHIFRVIISSVEDLKKFDALIPLSHSRKREKLKAILKEKRPYRGRYTYRVPISPEMIKPLRTRLNLTVAELSKLASKYAGETITESLIRHVEKGRTSEIRRSALKGIALALQRIAQDIGDEDAWVMAKRLELIADGDVYWDRVVEVEEVDPEEIGIEYLYDLTVDEDHNYVANGILLSNCMGTIHANSARETIVRLESPPMSVPRIMIPALDIILMQVRFHSRKKGTIRRVTEIAEVSGLEGESIQLNTLYKYDPAKDELVPTGVPSRTVNILAQHTGMSVREIELEIEKRRLILEWMVEKGIRDIDKVGYYIRQFYIDEEWLLNKISAESDVETSKQIQALM

SEQ ID NO: 642 - protein, 1390 aa, Thermococcus kodakaraensis KOD1
  Tko LHR precursor
MSGIRWAEREYTDEEIYSILSEPVREWFKRKFGTFTPPQRYAVLEIHKGENVLISSPTGSGKTLSAFLSAINELILLGKESKLEDKIYVLYVSPLRALNNDIKRNLEGPLAEIKEVAKELGYELPEIRVGIRTSDTSSYEKSKMVKKPPHILITTPESLAIALNAPKFSERLKTVKYVIIDEVHALAENKRGSHLALSIERLQEMAENEFVRIGLSATIHPLEEVAKFVFGFNDDGTPRPGLIVDVSFAKQTEIKVESVVEDLIYTDAGTLSDALYNRLAELIREHRTTLIFTNTRSGAERVAFNLKKRFPEFEGLIEAHHSSLSREVRLDVEEKLKRGELKAVVCVSGDSKILTGKGPVEIGRLNSNMIAGIWRFQTELVRFEEPHRVEYRREGVKIRTRLGFEIKATKEHKFLTVDENGELRWVEAWKLKEGNWVGVVRRLPSPNVKVSILDLLPPNAYLKLKGEFLRELKLSIQAKFGSIRTYAKKKRWSESYLVKQLNGVYPFRWERLSAVLKDLDLRMTENDVERITSDKGKYSLPIEFTPSMARLLGFWMADGSWKGGTLTLFSSDRKMLEKYKELCKEEFGVVGRIRMLNESTYSLEISFNLLPAIFKNLTGNTERKSKLGTFPSIIYSLPEEHKREFLAGYFDGDGFLEVKGGRVYSAGFSTFNKRFAEGIRDILLQLGIVSSIRAREYDEVQKFKGRVIPKKGASYTVSVLGGEYLKRFFDAVRPWRSDYEGWEGMYNEGYSNSDVVPNLGKRLRSIRERLGISAYRMSKMGFYNPVRVELGEREISRRNLRLLVEFYERVAKEKRVEDVLEELSYLRELAEGDVFFDRITSVEPAYIDVAYGIINSETENYIVEGFISKNSSTSLELGIDIGTIDLVVLIGSPKSVNRALQRIGRAGHRLHDVSKGVILALDRDDLVEVTVLAHNARNRRLDRVRIPKNPLDVLVQHIVGMALYKVWEVEEAYRLVRRAYPFHELPFEDFMSVLKYLSGGYEGLEDRKVYAKIWLEDGKFGRRGKMTRAIYYMNVGTIPDEAKIRVYTMDKQMIGTVEEEFAERLMPGDIFVLAGRTYEFIKSRGNKIYVVPREGAKPTIPAWFSEMLPLSFDLALDVQRFRREVKELLNKKRAKSLLMRKYGIDERAAKAIIAYFREQERYSTVPDDETVLVEEVEKENTYEYFFHTLIGRRANDALSRAFAYAVGRRKGVNVGIALNDNGFLLRVPKEARLSEAEIRELFQLEDLREILKRALDNTELLKRRFRHVANRGFLILRRYVGGSKRLGRQQVIAVSLLKVLKEHYPDFPLLKEVYREIMEDKMDVENAELFLSWVREGKIKVVFERNELPSPFAFNLEAIGSSDVVLMEDRREMIKALYRKIMALIGENAT

SEQ ID NO: 643 - protein, 1670 aa, Pyrococcus/ Thermococcus kodakaraensis KOD1
  Tko Pol-1 (Pko Pol-1) precursor
MILDTDYITEDGKPVIRIFKKENGEFKIEYDRTFEPYFYALLKDDSAIEEVKKITAERHGTVVTVKRVEKVQKKFLGRPVEVWKLYFTHPQDVPAIRDKIREHGAVIDIYEYDIPFAKRYLIDKGLVPMEGDEELKMLAFDIQTLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITPAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRCHPADTKVVVKGKGIINISEVQEGDYVLGIDGWQRVRKVWEYDYKGELVNINGLKCTPNHKLPVVTKNERQTRIRDSLAKSFLTKKVKGKIITTPLFYEIGRATSENIPEEEVLKGELAGILLAEGTLLRKDVEYFDSSRKKRRISHQYRVEITIGKDEEEFRDRITYIFERLFGITPSISEKKGTNAVTLKVAKKNVYLKVKEIMDNIESLHAPSVLRGFFEGDGSVNRVRRSIVATQGTKNEWKIKLVSKLLSQLGIPHQTYTYQYQENGKDRSRYILEITGKDGLILFQTLIGFISERKNALLNKAISQREMNNLENNGFYRLSEFNVSTEYYEGKVYDLTLEGTPYYFANGILTHNSLYPSIIITHNVSPDTLNREGCKEYDVAPQVGHRFCKDFPGFIPSLLGDLLEERQKIKKKMKATIDPIERKLLDYRQRAIKILANSILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYSSAMATSTEQETQALNEKRALANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHNSYYGYYGYARARWYCKECAESVTAWGREYITMTIKEIEEKYGFKVIYSDTDGFFATIPGADAETVKKKAMEFLNYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTRQVGLSAWLKPKGT

SEQ ID NO: 644 - protein, 1670 aa, Pyrococcus/Thermococcus kodakaraensis KOD1; identical to SEQ ID NO: 643
  Tko Pol-2 (Pko Pol-2) precursor

SEQ ID NO: 645 - protein, 1798 aa, Thermococcus kodakaraensis KOD1
  Tko Pol-II precursor
MSEEIYSPEMKAYFESLQREIDRAYAIARKARAQGKDPSFDVEVPQATDMAGRVESLVGPPGVAERIRELVKEYGKEIAALKVVDEIIEGKFGDLGSKEKYAEQAVRTALAILTEGIVSAPLEGIADVKIKRNEWADGSEYLALYYAGPIRSSGGTAQALSVLVGDYVRRKLGLDRFKPSDEHIERMVEEVDLYHRAVTRLQYHPEADEVRLAMRNIPIEITGEETDKVEVSHRNVPGVETNHLRGGAILVLAEGVLQKAKKLVKYIDKMGIEGWDWIKEFVEAKEKGKSSEENKDESKAEDTGTESVAEKKENVEKGFYYELYEKFRANIAPNKKYTKEIIGGRPLFAEPSTNGGFRLRYGRSRVSGFATWSVNPATMLILDEFIAIGTQMKTERPGKGCIVTPATTVEGPIVRLKNGSVVRVDDYETALKVRNEVDEILYVGDALVNFGDFVENNQTLLPANYVEEWWVQELVQAIKDLYEVELQPFAENDREAVEEAAEYLEVDPDFLWNLLKDPLRVKPDVETAIHLSTVLDIPFHPYYTLYWNTLQPEEVEELQKALLGAQIEWAEFRKNRFAKKVVLENDKNIKRYLELLGLPHRLERVEKKRKVIVVEYPWSAALLTPLGNLEWEFKAKPFYTVIDIINENNRIKLRDRGISWIGARMGRPEKAKERKMKPPVQVLFPIGLAGGQSRDIKKAAEEGKTARVEIAFFKCPKCGHVGPEHLCPVCGTRKELLWHCPKCGADYPESDAKDFNYRCPKCDVELKPYAEREIKPADLLRQAMDNVKVYGIDRLKGVKGMTSGYKMAEPLEKGLLRVKNDVYVFKDGTIRFDATDAPITHFKPKEIGTSVEKLRELGYTHDFEGKPLERDDQILELKVQDVILPYEAGRYLLKVARFIDDLLEKFYGLPRFYNAEKMEDLVGHLVIGLAPHTSAGIIGRIIGFSDVLVGYAHPYYHAAKRRNCFPGDTRILVQINGLPQRITLRELYDLFEDERYENMAYVRKKPKADVKVYSFDPESGKVVLTDIEDVIKAPSTDHLIRFELELGRSFETTVDHPVLVYENGKFVEKRAFEVREGDRILVPNLKLPEKNIDYLDLLKEFSREEFAHLHDRIMVRGIAEWLRSVEADVKEDYLRRDSIPLSVLLRVLTEKEISIEEVPSCWLGFKRDKVRIKRFVPLKPLLRVVGYYLAEGYARESKSVYQLSFSMAEKEVREDLKRALREAFGDGFGIYERGGKVTVGSRILYLLFTEVLKAGKNAYSKRVPSLVFTLPREAVAEMLKAYFEGDGSALKSVPRVVAYSVNKALLEDIETLLLAKFGIRGYYTFDNNANRGNARGRLYHVERGTEAPVSKVYALNIAGEHYHRFFNSIGFVSERKNSIYELHAEKSPAQDRYSSQNGWLVKVRRIEYITPKDDFVFSLNAKKYHNVIINESIVTHQCDGDEDAVMLLLDALLNFSKYYLPEKRGGKMDAPLVVTTRLDPREVDSEVHNMDVVRYYPLEFYKATYELKSPKEVKVIERVEDRLGKPEMYEGIKFTHDTDDIGLGPKMSLYKQLGDMEEKVARQLALAERIRAVDEHHVAETIINSHLVPDLRGNLRSFTRQEFRCVKCNTKYRRPPLTGKCPKCGGKIVLTVSKGAIEKYLPTAKMLVTKYRVKDYTRQRICITEKDIKTLFENVFPEKQRTLMGFSADICEKMVKERTGHSNGKNGYLDEFNGKNGKASKKSGSLASKLSGKGKEPSKKKESAKPKRSEKVKNLTSFEAAAKNEQARGTAGNAKKAESEKPKRKKRKGISLDEFFGS

SEQ ID NO: 646 - protein, 1711 aa, Thermococcus kodakaraensis KOD1
  Tko r-Gyr precursor
MKAVYREMCPNCWGRISDERLVMRNPCEECLDEPVHADSYFQLVSAVRNALKLRGTLKEWEKIYQLENQTREIEEFFKKATGFTFWSAQRTWVKRLLKGRSFSIIAPTGMGKSTFGAFMAVWHALKGKKSYIVVPTTPLVIQTVRKIEGIMENANADVRLAYYHGNLRKKEKEEMLERIKNEDYDILVTSAQWLARNYEEVLKGRHFDFIFVDDVDAFLKASKNIDRSLYLLGFTDEIIQKAWEIIRLKKQMSRYLNGNSEDRNEKLNGLNREIEKLQREIEKFKRKNKIGIMIIASATGSARGDRIKLYRELLGFEVGSGRSALRNVVDSYLKPTKDIKEHVEELLTRLGKGGLIFVPVDQGLGYAEELANYLSEKGFKIELVSSKNKKALEKFENGEADYLIGSATYYGSLVRGIDLPHLIRYAVFTGVPKFRFSIDLERPTIYRALGLLSEIMDFLSEEDRRQAEKLHARLRRLIRNIPQFELLKIEEALAEGLPIENEFHNHVLGVFRELVEFLRRVLRDEEVLRKLAEDPFISLVKEEGKWYIEIPDVRTYIQATGRTSRLFAGGITKGLSVLIVDNEKVFNGLVRQMRWRFQEFKMVPFEELDLDEILRQIDEDREKVRLVMEGKISAKVKDLVRSALMIVESPNKARTIANFFGQPSKTRIGDLVAYEISVGDRMLTILASGGHMFDLVTNEGYHGVLIQNEGDMLKFIPVYDTLKRCRDCGHQFVDWEKKGVCPRCGSTNVRDALENVIAMREIAQEVDEILIATDPDTEGEKIAWDIRNVLAPYTPNIKRIEFHEVTRPAIMKAIQEARDVNENRVNAQIVRRIEDRWIGFELSQELQRVFESYNLSAGRVQTPVLGWIIERYKEFTESEVYFLGLTLENGLQVTIELGKDGKDVEPPEYVTVEEVQLEERELNPAPPYTTDAMLKDASTFLKLSAPETMRLAQDLFEAGLCVTPDTLVSLADGRIMEIKDAVEKSEGNLLSVNGLKPKEAKALKFWEIDWNGPLKVIKLKNGHEIKATPDHGLLVMREGKLGWVSAKNVREGDYVAFAYNTGHRGRDEYTLLKLMIKLGITDVMVELDEEYFNEKVAPIVRERISTSTKYKYLRRRVLPLYLLQEWGLDDYEAHVKSLYRQRAGSKPIPNFKLDGRFWYVFGLVLGDGTLRDSKVLISQTPLKDVKSVLEDVFPFLRVFETTNQVGFSNSIIAEVFRRLGARKGKLHPLVFGLREEYINAMIAGYFDTDGTFSILNDRKGPNFRGILTSKRGDVLRMLSVYLYQIGIMNYLRRDERTGVWDLIISNRSLEKFREKIYPYLRIRRAQFDEAYSVYRASRRAFEGDLLPVAPVFGKLKFKNGTKNRILKETGIDVWNWLKRPEGEIPRDKLSKVLEYAEESPEKEFLKSLVEAGVTWVKVKGVEEELYTGKLYDFTTTTENFLSNGAVSHNCTYHRTDSTHVSNTGIEVAKEYITQELGEKYFKPRPWGEEGAHEAIRPTRPIDTGRLMQLIRDGIIQLPRNLTRNHYRLYDMIFRRFMTSQMTPAKILYEKAVINAGVGKAELEGYVEIIEDGWTRLRSPPLRELPKLEKGMKLKVVEAKKWKAPKVSLYTQGDIIALMKERKIGRPSTYAKIVETLMRRGYVVETKGRKKLLPTEKGIKVYHYLVSKYRDLVSEERTRELEEIMDRIEEGIEDYIKVLGELYSEIQRYVSG

SEQ ID NO: 647 - protein, 836 aa, Thermococcus kodakaraensis KOD1
  Tko RadA precursor
MARKKKVEDEVKELEEFEELDVEESLSSSDKQSKPEKKISALEDLPGVGPATAEKLREAGYDTIEAIAVASPLELKEIAGISEGAALKIIQAAREAANIGTFMRADEYMKRRTTIGKISTGSKALDKLLGGGIETQAITEVFGEFGSGKCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNTQLAHTLAVMVQKPPEEGGLGGSVIWIDTENTFRPERIKQIAENRGLDPEETLKNIYVARAFNSNHQMLLVEKAEEIIKEKAESDRPVKLLVVDSLMAHFRAEYVGRGTLAERQQKLAKHLADLHRLADLYDIAVFVTNQVQAKPDAFFGDPTRPVGGHILAHSATLRVYLRKGKAGKRVARLIDSPHLPEGEAVFRITEKGVED

SEQ ID NO: 648 - protein, 1746 aa, Thermococcus kodakaraensis KOD1
  Tko RIR1-1 precursor
MPVEKVMKRDGRIVPFDKERIRWAIQRAMLEVGVRDEKLLNRVVRRVVRRVNELYDGQIPNIENIQDIVELELMRAGLFDVAKAYILYRKKKAEIREEKKKILNKDKLDEIDKRFSLNALRVLASRYLIKNEKGEIIESPRELFERVAILAVIPDILYDERVFDKNGGHEQDVSAIERYRENLDEYDGKFSIGRFRLNKWHFERLLNLYRELAEKGQMKLPIDEVLKMLENGAFDNYEDEIEEYFRLMTGQYFMPNTPALINSGRPLGMLSACFVVPIEDDMESIMKAAHDVAMIQKAGGGCIDGNAKIIFENDGEEHIMTMAEMYERYKDLGEFYDPEYNRWGINVEEVPVYVKSFDPSTKEITKGKVKVIWKYELGEDVPKYEIKTNKGTRVLTSPWHPFFVITQDLKIVEKRADELREGDMLVGGMPSDDDYEFLLDYWLAGFIAGDGSIDKYRSHVKGHEYVYDRLRIYDYTTETLGIINDHLEKTFGKRYSLQRDRNIHYIDIKAKGITSHYIELLRGITNGIPQPILKEGRNAVLSFITGLFDAEGHVNSKPGVELGMVNRKLIEDITYYLNSLGIKARMRKKPRKDGVDYVMHVEEYSSLLRFYELIGKNLQNSEKRIKLEELLSKHNGGSFGLTLSFEDFKAWSSKYGVEFKTNGSQTLAIIKNEKVSLGQWHRRGRVSKAVLVKMLRKLYDTTKSEDVKRMLHLIEGLEVVKEINVTNEPKTFYDLTVERYQNYLAGENGMVFVHNTGLNFSKLRPEGDLVGTTTGAASGPVSFMHLIDAVSDVIKQGGVRRGANMGILEVWHPDIEKFIHAKEKNTGTNVLSNFNISVGLWEDFWEALKEGKRYPLINPRTGEKVKEIDPKSLFEELAYMAWAKADPGVVFFDVINRRNVLEPAKGEKIRATNPCVVGDTRVLTPEGYIKAEELFSLAKERGKKEAVAVEGIAEEGEPYAYSVEVLLPGEEEVKYETVHGKALAIADPVAVPAYVWKVGKKKVARVRTKQGYEITATLDHRLMTSEGWKEVGELKPGDEILLPRFEIEEDFGSESIGEDLAFVLGWFIGDGYLNVNDKRAWFYFNAEKEEDIAWKIREILAKHFGIKAEPHRYGNQIKLGVRGEAYRWLESIMGSNEKRVPEIIYRLKPREIAAFLRGLFSADGYVDNDNAVRLTSKDRGLLRDVQDLLLLFGILSKIYERPYSSEFKYTTKDGEERTYRAEGYYELVIANYSRKLFAEKIGFEGYKMEKLSLQKTKIDEPVVTVESVEVLGEEIVYDFTVPEHHSYISNGFMSHNCGEEPLYEYESCNLASINLAKFVKYDDEGKPYFDWDEYAYVIQKVAKYLDNAIDVNKFPLPEIDRNTKLTRRIGVGMMGLADALFKLGIPYNSKEGFDFMRKATEYLTFYAYKRSVEAAKERGPFPLYEKTRYKDGELPVEGFYHREIWNLPWDELVEEIKKYGVRNGMVTTCPPTGSVSMIADTSSGIEPIFALVYKKSVTVGEFYYVDPVFEAELKKRGLWSDEILKKISDNYGSVQGLEEIPEDMQRVFVTAMDIHWLDHILAQANIQLWLTDSASKTINMPNDATVEDVKAAYLLAYKLGCKGVTVYRDGSLSVQVYSVEGEKKKRVPAKPSDYAVEKLKTIVEAEPWLSRFINVEAILNGTNGKEKSAQAGGLTFSVSHVSAVKPAHEHSHHAKRPDIPEEKIRELLGVAYCPVCYEKDGELVELRMESGCATCPRCGWSKCVIS

SEQ ID NO: 649 - protein, 1746 aa, Thermococcus kodakaraensis KOD1; identical to SEQ ID NO: 648
  Tko RIR1-2 precursor

SEQ ID NO: 650 - protein, 1229 aa, Thermococcus kodakaraensis KOD1
  Tko TopA precursor
MVTLIIAEKPNVARKIAYALAEGKPVRKTIGKVSYYEFTRDGKKVIVAPAVGHLFSLAPKTKTYGYPVFDIEWVPVYVAEKGKSYAKDYIKALATLAKQADEFVVACDYDTEGEVIGYTALKYACGVDPSKAKRMKFSALTKKDLLKAWYNMEPTINFGMADAGIARHVLDWYWGVNLSRALTSAIKRASGKWMVLSTGRVQGPTLKFLVEREKEIQNFEPKPYWVIKMLLEKNGGQYTAVYEKEKVWDEEEAKKIVEEAKKGPAFVEKVEVKQQNRNPPVPFDLGTLQREAYSAFGYSPKKTLDIAQKLYEKGYCLHPDSLIPTPQGVKRIKELPEKGEVFALDFDLKLSRARYRLLERDADEPMYKVTLSDRTELYLTADHPVLVYRDDQLIFVPAEELRENDQVVLFINRSEYSPRTESPTLLGFLLENATSMKDYILYDPEFGGVLRNRIKDAGLKTEILWRFRIREPTYYKYLRGKMPVPIVRFLLEEGVVSIEELREVFRGFSYSTSLTPISFEFSEEFWYLFGLVAGDGHLAKKGAITIPAKDRTEDTVKAVKEIANSLQVPFAFDEKYKMIILRSKSLTRLFELLGCPYGNKTEIFRIPGEIMAKPEWMAAFLAGYYDADGHIGTKPTGGKKSHSPQIVLTSKNRMAIYTVKQMWQLLGVGTYLWEKKDRNGNFMAYELKVYSRDAWRFYEVMKNHLRIKRKDLEHVKEVAIRKRKAYSHHYSVLNVKSWEGKIKSSNVLWKKFDMSNQTAHGRGISLDKLQRIVDYLTDTDLRRIAMGDVYVLGIRSIEKFHYRGKVYDLVVDQYHNFIANGVVVHNCSYPRTSSQKLPKNLNFRSIIQNLAKLPEYKPFAHELLGKESLKPVEGKKDDPAHPAIYPTGELPKPGELTKDEGNLYDLIVRRFLALFMEPAVRETMKVVINSNNHRFILSGARTLKEGWLKVYGKYVKFDEVILPAFKEGEPVKVIQIKREKKKTKPPARYSPAAVIKKMEDLGIGTKATRAQILETLYQRGYIEGKKKIKVTPLGMRVVEALEKNVPDIVSVELTRAFEEKMEEIMAGKADKDQVIEESKEQLIKILQVFKEKELDIGKMLLESTGTGVTTSKEAAKKTGAVKDANDEEKSDGKAGEGTTPKAERKPLVVGKCPKCGGDLVIRYNRKTGKRFVGCSNWPKCDVTYPILQRGQVIPTEKTCCNGAPVVKIREKGREYEICLDMNCKDWKKK

SEQ ID NO: 651 - protein, 1702 aa, Thermococcus litoralis
  Tli Pol-1 precursor
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSILPNEWLPIIENGEIKFVKIGEFINSYMEKQKENVKTVENTEVLEVNNLFAFSFNKKIKESEVKKVKALIRHKYKGKAYEIQLSSGRKINITAGHSLFTVRNGEIKEVSGDGIKEGDLIVAPKKIKLNEKGVSINIPELISDLSEEETADIVMTISAKGRKNFFKGMLRTLRWMFGEENRRIRTFNRYLFHLEKLGLIKLLPRGYEVTDWERLKKYKQLYEKLAGSVKYNGNKREYLVMFNEIKDFISYFPQKELEEWKIGTLNGFRTNCILKVDEDFGKLLGYYVSEGYAGAQKNKTGGISYSVKLYNEDPNVLESMKNVAEKFFGKVRVDRNCVSISKKMAYLVMKCLCGALAENKRIPSVILTSPEPVRWSFLEAYFTGDGDIHPSKRFRLSTKSELLANQLVFLLNSLGISSVKIGFDSGVYRVYINEDLQFPQTSREKNTYYSNLIPKEILRDVFGKEFQKNMTFKKFKELVDSGKLNREKAKLLEFFINGDIVLDRVKSVKEKDYEGYVYDLSVEDNENFLVGFGLLYAHNSYYGYMGYPKARWYSKECAESVTAWGRHYIEMTIREIEEKFGFKVLYADSVSGESEIIIRQNGKIRFVKIKDLFSKVDYSIGEKEYCILEGVEALTLDDDGKLVWKPVPYVMRHRANKRMFRIWLTNSWYIDVTEDHSLIGYLNTSKTKTAKKIGERLKEVKPFELGKAVKSLICPNAPLKDENTKTSEIAVKFWELVGLIVGDGNWGGDSRWAEYYLGLSTGKDAEEIKQKLLEPLKTYGVISNYYPKNEKGDFNILAKSLVKFMKRHFKDEKGRRKIPEFMYELPVTYIEAFLRGLFSADGTVTIRKGVPEIRLTNIDADFLREVRKLLWIVGISNSIFAETTPNRYNGVSTGTYSKHLRIKNKWRFAERIGFLIERKQKRLLEHLKSARVKRNTIDFGFDLVHVKKVEEIPYEGYVYDIEVEETHRFFANNILVHNTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSKQTGLDAWLKR

SEQ ID NO: 652 - protein, 1702 aa, Thermococcus litoralis; identical to SEQ ID NO: 651
  Tli Pol-2 precursor

SEQ ID NO: 653 - protein, 546 aa, Torulaspora pretoriensis, strain CBS 5080
  Tpr VMA precursor
ISQSLSKYSNSDAIIYVGCFAKGTKVLLHDGSLRAIESIEVGEDVMGVDGERRKVVGLPRGREVMYKVSQKTTNRAHETAETRSEPLGLFEYTCNATHKLVVRTPRSCRLLTRNENGADYYDVAFFDLVKTKLKDGREIEIVKEMSNSYLATEGPEKAAQMVKEYQEASEGKEFFEWTIEARDVAVLGADVREATYQVYSPVLYESDFFSQYVKDSKFGLTSEAPLALAYLLGLWAGDVSSEETVFSVNSEDGSLYERITQFADILGLSAEFKDREAPKQGKTVYLHPKAIGGNDIQENSNNDNPLRNAIVDLGYLTDGVKNVPTYLLSDAIPHREIFLAGLIDSDGFVRSEDGCSATIKTTLKTVMAGTVAVARSLGLNVSVNTEEAKVDNGVDQRLSYAISISVSDALLSVLAKCAGAEMFRELPASEVVRKMNKVYFEMEELEEDDYYGLTLANGTDHQFMLANQLVVHNCGERGNEMAEVLMEFPELHTEKNGKMEPIMKRTTLVANTSNMPVAAREASIYTGITLAEYFRDQGRDVAMIAD

SEQ ID NO: 654 - protein, 1699 aa, Thermococcus species GE8
  Tsp-GE8 Pol-1 precursor
MILDTDYITEDGKPVIRVFKKENGEFKIEYDRNFEPYFYALLKDDSAIEEVKKITAKRHGTVVKVKRAEKVKKKFLGRPIEVWKLYFTHPQDVPAIRDKIREHPAVIDIYEYDIPFAKRYLIDKGLIPMEGDEKLKMLAFDIETLYHEGEEFAEGPILMISYADEEGARVITWKKVDLPYVDVVSTEKEMIKRFLRVVKEKDPDVLITYNGDNFDFAYLKRRSEKLGVKFILGRDGSEPKIQRMGDRFAVEVKGRIHFDLYPVIRRTINLPTYTLEAVYEAIFGKPKEKVYAEEIATAWETGEGLERVARYSMEDAKVTFELGKEFFPMEAQLSRLIGQSLWDVSRSSTGNLVEWFLLRKAYERNELAPNKPDERELARRRQSYAGGYVKEPERGLWNNIVYLDFRSLYPSIIITHNVSPDTLNREGCKEYDVAPQVGHKFCKDFPGFIPSLLGDLLEERQKIKRKMRATIDPVEKKLLDYRQRAIKILANSILPDEWLPLLVNGRLKLVRIGDFVDNTMKKGQPLENDGTEVLEVSGIEAISFNRKTKIAEIKPVKALIRHRYRGKVYDIKLSSGRNIKVTEGHSLFAFRDGELVEVTGGEIKPGDFIAVPRRVNLPERHERINLIEILLGLPPEETSDIVLTIPVKGRKNFFKGMLRTLRWIFEEEQRPRTARRYLEHLQKLGYVKLMKRAYEIVNKEALRNYRKLYEVLAERVKYNGNKREYLVHFNDLRNEIKFMPDEELEEWKVGTLNGFRMEPFIEVGEDFAKLLGYYVSEGYARKQRNQKNGWSYSVKIYNNDQRVLDDMEKLASKFFGRVRRGKNYVEISRKMAYVLFESLCGTLAENKRVPEVIFTSPESVRWAFFEGYFIGDGDLHPSKRVRLSTKSEELVNGLVVLLNSLGISAIKIRFDSGVYRVLVNEELPFLGNRKRKNAYYSHVIPKEILEETFGKQFQKNMSPAKLNEKVEKGELDAGKARRIAWLLEGDIVLDRVEKVTVEDYEGYVYDLSVEENENFLAGFGMLYAHNSYYGYYGYAKARWYCRECAESVTAWGRSYIETTIREIEEKFGFKVLYADSVAGNTEVIIRRNGKVEFVPIEKLFQRVDYRIGEKEYCALEGVEALTLDNRGRLVWRKVPYIMRHKTNKKIYRVWFTNSWYLDVTEDHSLIGYLNTSKVKSEKPLKERLVEVKPRELGEKVKSLITLNRAIARSIKANPIAVRLWELIGLLVGDGNWGGHSKWAKYYVGLSCGLDKAEIEEKVLRPLKEAGIISNYYGKSKKGDVSILSKWLAGFMVKYFKDENGNKRIPSFMFNLPREYIEAFLRGLFSADGTVSLRRGIPEIRLTSVNRELSNEVRKLLWLVGVSNSMFTETTPNKYLGNESGTRSIHVRIKNKHRFAKRIGFLLDRKATKLSDNLREHTNKKMAYRYDFDLVYPKKIEEINYDRYVYDIEVEGTHRFFANGILVHNTDGFFATIPGADAETVKKKAMEFLKYINAKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTKQVGLGAWLKVKGKK

SEQ ID NO: 655 - protein, 1699 aa, Thermococcus species GE8; identical to SEQ ID NO: 654
  Tsp-GE8 Pol-2 precursor

SEQ ID NO: 656 - protein, 1701 aa, Thermococcus species GT
  Tsp-GT Pol-1 precursor
MILDTDYITEDGKPVIRIFKKENGEFKIEYDREFEPYIYALLKDDSAIEDVKKITAGRHGRVVKVKRAEKVKKKFLGRPIEVWKLYFTHPQDVPAIRDEIRKHPAVIDIYEYDIPFAKRYLIDRGLIPMEGDEELKMMSFDIETLYHEGEEFGTGPILMISYADEGEARVITWKKIDLPYVEVVSTEKEMIKRFLKVVKEKDPDVLITYNGDNFDFAYLKKRCEKLGIKFTLGRDGSEPKIQRMGDRFAVEVKGRIHFDLYPVIRRTINLPTYTLEAVYEAVFGTPKEKVYPEEITTAWETGEGLERVARYSMEDAKVTYELGREFFPMEAQLSRLIGQSLWDVSRSSTGNLVEWFLLRKAYERNEIAPNKPDERELARRRGGYAGGYVKEPERGLWDNIVYLDFMSLYPSIIITHNVSPDTLNREGCKEYDTAPQVGHKFCKDVQGFIPSLLGALLDERQKIKKRMKASIDPLEKKLLDYRQKAIKILANSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRNVSYEKFRELVKSEKLDGEKAKRIEWLLNGDVVLDKVLEVKKRPYEGYVYDLSVEEDENFLAGFGLLYAHNSYYGYYGYARARWYCKECAESVTAWGRDYIETTIHEIEERFGFKVLYADSVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYYVGLSLGLDKEEIEEKILKPLKNTGIISNYYDRSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHNTDGFFATIPGADAETVKKKAKEFLKYINAKLPGLLELEYEGFYVRGFFVTKKKYAVIDEEGKITTRGLEIVRRDWSEIAKETQARVLEAILRHGDVEEAVRIVKDVTEKLSKYEVPPEKLVIHEQITRELKDYKATGPHVAIAKRLAARGIKIRPGTVISYIVLKGSGRIGDRAIPFDEFDPTKHRYDAEYYIENQVLPAVERILKAFGYKNEDLRYQKTRQVGLGAWLKPKGKK

SEQ ID NO: 657 - protein, 1701 aa, Thermococcus species GT; identical to SEQ ID NO: 656
  Tsp-GT Pol-2 precursor

SEQ ID NO: 658 - protein, 2067 aa, Thermus thermophilus HB27
  Tth-HB27 DnaE-1 precursor
MGRKLRFAHLHQHTQFSLLDGAAKLSDLLKWVKETTPEDPALAMTDHGNLFGAVEFYKKATEMGIKPILGYEAYVAAESRFDRKRGKGLDGGYFHLTLLAKDFTGYQNLVRLASRAYLEGFYEKPRIDREILREHAEGLIALSGCLGAEIPQFILQDRLDLAEARLNEYLSIFKDRFFIEIQNHGLPEQKKVNEVLKEFARKYGLGMVATNDGHYVRKEDARAHEVLLAIQSKSTLDDPGRWRFPCDEFYVKTPEEMRAMFPEEEWGDEPFDNTVEIARMCNVELPIGDKMVYRIPRFPLPEGRTEAQYLMELTFKGLLRRYPDRITEGFYREVFRLLGKLPPHGDGEALAEALAQVEREAWERLMKSLPPLAGVKEWTAEAIFHRALYELSVIERMGFPGYFLIVQDYINWARRNGVSVGPGRGSAAGSLVAYAVGITNIDPLRFGLLFERFLNPERVSMPDIDTDFSDRERDRVIQYVRERYGEDKVAQIGTLGSLASKAALKDVARVYGIPHKKAEELAKLIPVQFGKPKPLQEAIQVVPELRAEMEKDPKVREVLEVAMRLEGLNRHASVHAAGVVIAAEPLTDLVPLMRDQEGRPVTQYDMGAVEALGLLKMDFLGLRTLTFLDEVKRIVKASQGVELDYDALPLDDPKTFALLSRGETKGVFQLESGGMTATLRGLKPRRFEDLIAILSLYRPGPMEHIPTYIRRHHGLEPVSYSEFPHAEKYLKPILDETYGIPVYQEQIMQIASAVAGYSLGEADLLRRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSMGKKKVEEMKSHRERFVQGAKERGVPEEEANRLFDMLEAFANYGFNKCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTGDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNSHAAAYSLLSYQTAYVKAHYPVEFMAALLSVERHDSDKVAEYIRDARAMGIEVLPPDVNRSGFDFLVQGRQILFGLSAVKNVGEAAAEAILRERERGGPYRSLGDFLKRLDEKVLNKRTLEFLIKAGALDGFGERARLLASLEGLLKWAAENREKARSGMMGLFSEVEEPPLAEAAPLDEITRLRYEKEALGIYVSGHPILRYPGLRETATCTLEELPHLARDLPPRSRVLLAGMVEEVVRKPTKSGGMMARFVLSDETGALEAVAFGRAYDQVSPRLKEDTPVLVLAEVEREEGGVRVLAQAVWTYEELEQVPRALEVEVEASLLDDRGVAHLKSLLDEHAGTLPLYVRVQGAFGEALLALREVRVGEEALGALEAAGFRAYLLPDREVLLQGGQAGEAQEAVPF

SEQ ID NO: 659 - protein, 2067 aa, Thermus thermophilus HB27; identical to SEQ ID NO: 658
  Tth-HB27 DnaE-2 precursor

SEQ ID NO: 660 - protein, 1800 aa, Thermus thermophilus HB27
  Tth-HB27 RIR1-1 precursor
MRDGYFFDEHAQAIARRQYLQPGDGDILGMFRRVAREIAKAEREEERSKWEEEFFRLMAEKRFSPGGRILAGAGTVHGNLLNCFVQGATENPPESFAGIMEVAKKLALVTKVGGGNGVNLDPYRSKGKRARRAVEGVAYLSAEHPDVEDFIRGLMRPPINPDGAKEEISLKNFARVVYGALSPELKALAERYGVRTVKEPPEGRILVPDDMGGIIDAAREAADLARKGQKPHVDFSLLRPEGAPIRGSGGTSSGPVSFLFEIFDNFLEWVAWGAEEAGPVATLRYVYAPVLRVVRQGGCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYGVRVVTAKGLERYLERIGVPKGSRLEALHGIKPDVRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNTRRGAGMATLSIEHPDLLDFLTAKDLDREKAEGDISTFNISVLATDRFLEAVEKDELWPVTPIEVPGKYYPYPVEGPYTGKLPSLPEREDGAKAIPLYGGKVPARWLWHEIAWHAWATGEPGLIFVDRVNALSALKGLGERYQIRSTNPCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGPGTLQETRSNTFHLHFNRIPAEFFQALGVKAARATEKRVPESLFRAPREAVVGFLQGLFSADGSVQINENKQDATVRLASSSLALLQDVQLLLLNLGILGKIHKRREAARKALPDGKGGLREYPVAPQYELILGGENRDRFAEVVGFLQEEKQSKLLAFLRHRPRGSYRKPFLATVASVEPAGEAPVYDLTEPVTHSLIANGLVAHNCGEIPLTVGEPCDLGAMNLAAYVKDGEFQMEEFRRDVRTAIRFLDNVLDVNKFALPDNEMAAKSLRRLGLGLMGLADALIKMGLPYDSEEARRKVYEIVSVMREEAIRASEALAEERGPFPLYEEHREYFQSLGIRPRRNVALLTVAPTGTTSMLMGVSSGIEPVFSPFVWRRIGGEYKPLLHPLFVELMEAYPPAPGYAKDGKWDWEKIIEEIQKDGHGSVQNLPFVPEAIRKVFLCAHDVHPLDHVRMQGAVQRAFDAEGYAANSISKTINLPNHAAVEDVEAAYTEAYRTGCKGITVYRDGSREFQVLTVKKEAKEEKAGKTPEEAKPQEARAHEPGRPVYERPGRLMGFTDMVKLFAPDGSKRSFLVTVNTLEGRPIEVILTSGKAGDEANADSEALGRVVSIALQYGVPPEAIVRTLRGINGGLYGTYQGRLVSSKADLIAVALETVPQMAPGAPEDLSSAPVLSGGGIALAGAAPCPSCGEKALVREEGCWKCQACGYAKCG

SEQ ID NO: 661 - protein, 1800 aa, Thermus thermophilus HB27; identical to SEQ ID NO: 660
  Tth-HB27 RIR1-2 precursor

SEQ ID NO: 662 - protein, 2067 aa, Thermus thermophilus HB8
  Tth-HB8 DnaE-1 precursor
MGRKLRFAHLHQHTQFSLLDGAAKLSDLLKWVKETTPEDPALAMTDHGNLFGAVEFYKKATEMGIKPILGYEAYVAAESRFDRKRGKGLDGGYFHLTLLAKDFTGYQNLVRLASRAYLEGFYEKPRIDREILREHAEGLIALSGCLGAEIPQFILQDRLDLAEARLNEYLSIFKDRFFIEIQNHGLPEQKKVNEVLKEFARKYGLGMVATNDGHYVRKEDARAHEVLLAIQSKSTLDDPGRWRFPCDEFYVKTPEEMRAMFPEEEWGDEPFDNTVEIARMCNVELPIGDKMVYRIPRFPLPEGRTEAQYLMELTFKGLLRRYPDRITEGFYREVFRLLGKLPPHGDGEALAEALAQVEREAWERLMKSLPPLAGVKEWTAEAIFHRALYELSVIERMGFPGYFLIVQDYINWARRNGVSVGPGRGSAAGSLVAYAVGITNIDPLRFGLLFERFLNPERVSMPDIDTDFSDRERDRVIQYVRERYGEDKVAQIGTLGSLASKAALKDVARVYGIPHKKAEELAKLIPVQFGKPKPLQEAIQVVPELRAEMEKDPKVREVLEVAMRLEGLNRHASVHAAGVVIAAEPLTDLVPLMRDQEGRPVTQYDMGAVEALGLLKMDFLGLRTLTFLDEVKRIVKASQGVELDYDALPLDDPKTFALLSRGETKGVFQLESGGMTATLRGLKPRRFEDLIAILSLYRPGPMEHIPTYIRRHHGLEPVSYSEFPHAEKYLKPILDETYGIPVYQEQIMQIASAVAGYSLGEADLLRRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVPPAVAYRISEAKRRSGLSWSEAGRRVAVAGSCLSSGLNLKRPRRYLFRHRLFLLGEAFADPGLEALAEGQVLWDPIVAVEPAGKARTFDLRVPPFANFVSEDLVVHNSMGKKKVEEMKSHRERFVQGAKERGVPEEEANRLFDMLEAFANYGFNKCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTRDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNSHAAAYSLLSYQTAYVKAHYPVEFMAALLSVERHDSDKVAEYIRDARAMGIEVLPPDVNRSGFDFLVQGRQILFGLSAVKNVGEAAAEAILRERERGGPYRSLGDFLKRLDEKVLNKRTLESLIKAGALDGFGERARLLASLEGLLKWAAENREKARSGMMGLFSEVEEPPLAEAAPLDEITRLRYEKEALGIYVSGHPILRYPGLRETATCTLEELPHLARDLPPRSRVLLAGMVEEVVRKPTKSGGMMARFVLSDETGALEAVAFGRAYDQVSPRLKEDTPVLVLAEVEREEGGVRVLAQAVWTYEELEQVPRALEVEVEASLLDDRGVAHLKSLLDEHAGTLPLYVRVQGAFGEALLALREVRVGEEALGALEAAGFRAYLLPDREVLLQGGQAGEAQEAVPF

SEQ ID NO: 663 - protein, 2067 aa, Thermus thermophilus HB8; identical to SEQ ID NO: 662
  Tth-HB8 DnaE-2 precursor

SEQ ID NO: 664 - protein, 2202 aa, Thermus thermophilus HB8
  Tth-HB8 RIR1-2 precursor
MDMRDGYFFDEHAQAIARRQYLQPGDGDILGMFRRVAREIAKAEREEERSKWEEEFFRLMAEKRFSPGGRILAGAGTVHGNLLNCFVQGATENPPESFAGIMEVAKKLALVTKVGGGNGVNLDPYRSKGKRARRAVEGVAYLSAEHPDVEDFIRGLMRPPINPDGAKEEISLKNFARVVYGALSPELKALAERYGVRTVKEPPEGRILVPDDMGGIIDAAREAADLARKGQKPHVDFSLLRPEGAPIRGSGGTSSGPVSFLFEIFDNFLEWVAWGAEEAGPVATLRYVYAPVLRVVRQGGCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYRVRVVTAKGLERYLERIGVPKGSRLEALHGIKPDIRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNTRRGAGMATLSIEHPDLLDFLTAKDLDREKAEGDISTFNISVLATDRFLEAVEKDELWPVTPIEVPGKYYPYPVEGPYTGKLPPLPEREDGAKAIPLYGGKVPARWLWHEIAWHAWATGEPGLIFVDRVNALSALKGLGERYQIRSTNPCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGQGTLQETRSDTFHLHFNRIPAEFFQALGLKAARATEKRVPESLFRAPREAVVGFLQGLFSADGSVQINEKKQDATIRLASSSLALLQDVQLLLLNLGILGKIHKRREAARKALPDGKGALREYPVAPQYELILGGENRDRFAEVVGFLQEEKQSKLLAFLRHRPRGSYRKPFLATVASVEPAGEAPVYDLTEPVTHSLIANGLVAHNCGEIPLTVGEPCDLGAMNLAAYVKDGEFQMEEFRRDVRTAIRFLDNVLDVNKFALPDNEMAAKKLRRLGLGLMGLADALIKMGLPYDSEEARRKVYEIVSAMREEAIRASEALAEERGPFPLYEEHREYFQSLGIKPRRNVALLTVAPTGTTSMLMGVSSGIEPVFSPFVWRRIGGEYKPLLHPLFVELMEAYPPAPGFAKEGKWDWEKIVEEIQKDGHGSVQNLPFVPEAIRRVFLSAHDIHPLDHVRMQGAVQRAFDAEGYAANSISKCIAKGTLIPTSKGLIPIEEIAPPHPEDTFVPVEGLYTAEGYRITAHYYAGKKRGVRIRLDNGAELVGAWESHRLLTPEGWRLMRELKPGDVVLGKLVPSHGEGGLPIPEAKGLSLRTNARNLPLPERMSEDLALFLGMLAADGSTVEATGFVGIATKDPDVERVFQEVAGRLFGVEPKCTVDKRTGVRNLYLTSRRLVRFVEALIGKGAAQKRVPSQILQGSPGEKLAFLRGLTLDGYVHANMGLVVYEGRSQRLAYEAAELARSFGLPKVYQGRKKVLAPKETYYVHSVAVSGPLQELLEPLEAHKRAKVEARYKVFVPQEVLAATRVGTHHPGYVSLKSVRQREAQAVYNTTAERLGWPTEILAHRVVEVEEVGEVEMYDIEVEEVHRYVVNGLISHNTINLPNHATVEDVEAAYTEAYRTGCKGITVYRDGSREFQVLTVKKEAKEEKAGKTPEEAKPQEARAHEPGRPVYERPGRLMGFTDMVKLFAPDGSKRSFLVTVNTLEGRPIEVILTSGKAGDEANADSEALGRVVSIALQYGVPPEAIVRTLRGINGGLYGTYQGRLVSSKADLIAVALETVPQMAPGAPEDLSSAPVLSGGGIALAGAAPCPSCGEKALVREEGCWKCQACGYAKCG

SEQ ID NO: 665 - protein, 1467 aa, Thermococcus zilligii
  Tzi Pol precursor
MILDADYITEDGKPVIRVFKKEKGEFKIDYDRDFEPYIYALLKDDSAIEDIKKITAERHGTTVRVTRAERVKKKFLGRPVEVWKLYFTHPQDVPAIRDKIREHPAVVDIYEYDIPFAKRYLIDRGLIPMEGDEELRMLAFDIETLYHEGEEFGEGPILMISYADEEGARVITWKNIDLPYVESVSTEKEMIKRFLKVIQEKDPDVLITYNGDNFDFAYLKKRSETLGVKFILGRDGSEPKIQRMGDRFAVEVKGRIHFDLYPVIRRTINLPTYTLETVYEAIFGQPKEKVYAEEIARAWESGEGLERVARYSMEDAKATYELGKEFFPMEAQLSRLVGQSLWDVSRSSTGNLVEWFLLRKAYERNELAPNKPDERELARRAESYAGGYVKEPEKGLWENIVYLDYKSLYPSIIITHNVSPDTLNREGCREYDVAPQVGHRFCKDFPGFIPSLLGDLLEERQKVKKKMKATVDPIERKLLDYRQRAIKILANSILPDEWIPLLINGRLKLVRIGDFVDSAMKELKPMKRDETEVLEVSGIGAISFNRKTKRSETMPVRALLRHRYSGKVYGIKLSSGRKIKVTAGHSLFTFRDGELVEIKGEEIKPGDFIAVPGRINLPERQERINLVEVLLGLPEEETADIVLTIPVKGRRNFFKGMLRTLRWIFGEEKRPGTARRYLEHLQTLGYVRLGKIGYEIVNEEALRDYRGLYETLTGKVKYNGNKREYLVHFNDLRDIIRLMPEKELKEWKVGTLNGFRMETSIEVKEDFAKLLSYYVSEGYAGKQRSQKNGWNYSVKLYNNDQNVLDDMETLASKFFGKVRRGKNYVEIPRKMAYVLFESLCGTLAENKRVPEIIFTSPESVRWAFLEGCFIGDGDLHPGKGVRLSTKSEELVNGLVILLNSLGVSALRIWLDSGVYRVLVNEELPFLDKGKKKTPYVTSKEIPEEAFGKRFQRNISLEKLREKVEKGEPDAEKVKRVVWLLEGDIVLDRVEEVAVDDYEGYVYDLSVEENENFLAGFGMLYAHNSYYGYYGYANARWYCRECAESVTAWGRQYIETTMREIEEKFGFKVLYADSVTGDTEVIIRRNGRIEFVPIERLFEHVDYRVGEKEYCVLSGVEALTLDNRGRLVWKKVPYVMRHKTDKRIYRVWVTNSRYLNVTEDHSLIGYLDGKYLEIRPADIPKDPDIKLITLASPGLQEVALKTPSRLEEITYEGYVYDIEVEGTHRFFANGILVHNTDGFFATIPGADAETVKKKAKEFLNYINPRLPGLLELEYEGFYRRGFFVTKKKYAVIDEEDKITTRGLEIVRRDWSEIAKETQARVLEAILKHGDVEEAVRIVKEVTEKLSRYEVPPEKLVIYEQITRDLRDYRATGPHVAVAKRLAARGIKIRPGTVISYIVLKGPGRVGDRAIPFDEFDPAKHRYDAEYYIENQVLPAVERILRAFGYRKEDLRYQKTKQAGLGAWLKPKT

SEQ ID NO: 666 - protein, 666 aa, uncultured archaeon GZfos13E1
  Unc-ERS PFL precursor
MNIGGFQRFSLIDYPGKICAIVFTQGCNFRCPYCFTGNTEISTDRGLFKIKDIVEKHIECRVYDYAGNFSPIKKYYKRETSSLLEIRPFLHSDAISCTLNHEFFVYNSKANEFIKKEAQYINVKEDYLVITIPQKEIFNYKLDVNNAIEDLYQELTFKQRFSNEEVIREVKELRKRGFSWRKIFKRFNLTDHLRRVIERKEALDSKILPIVKERDGKVAVKGSNFFIDKFIEVTPKFTRLLGYYLSEGCSSKDIGRKNSYYVSFTFNSKEKEYIRDTKEIFSETFKTELKEVESKKCKTLSLVSYKGIIGLFFKYYFGEDVYNKKLPTEFIYLDKDLQKQLIIGLFRGDGLTSPDFIKKYKKQRIQITSKLLRYQISLILLRLGIKYSIFRKEIIISDKRIFDLLGQSHLITKKVINTSNRYGFLDDKHLYLKINSVKKLNKKTKVYNLEIDNPTHSYNVNLISVSNCHNPELVDPKQFSNLISEKKIFSFLEERRGKLDAVEITGGEPTLQPDLIDFMCDLKKLDYLVKLDSNGSKPEILSEAIEHEIVDYIAMDVKAPLERYQEITNSRVDPVKIEHSIELIMSSGLDYEFRTTVVKSQLGKRDILEIGRLIRGSKRYILQKFVPVKVLDKKFLDEVFFYTDDELESLRNAVKRKGYVAECKVR

SEQ ID NO: 667 - protein, 914 aa, uncultured archaeon GZfos9C4
  Unc-ERS RIR1 precursor
MKTTVSKIRKKNFIGAKDDLKLSLNAVEVLKRRYLLKNELGGVIETPSQMFKRVAKAIARAELNYGKSKEEVKEIERRFYLLMRNLEFLPNSPTLMNAGTELGQLAACFVLPVEDSIGGIFGAVKKMAKIHQSGGGTGFSFSRLRPKGDVVKSTGGVASGPVSFMRVFDVATDVIKQGGKRRGANMGILNAEHPDILEFIRAKERGEFANFNTSVAVTDEFMRAVERNDEYGLVNPRTKGEVKRIKAREVFNEIVTYAWKTGDPGIVFMDEINRRNTIPAVGKIEATNPCVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLFDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHNCGEQPLLPYDSCNLGSINVSKFVKSGDGEIDWERLREVICISVKFLDDVIDVNRYPLPEIEKMTKANRKIGLGIMGFAELLIKLGIAYDSKDALSTGEKLMQFITNEARRCSTELGLERGSFSNFELSVWNSKYEAMRNATVTTIAPTGTISIIAGCSSGIEPIFAVAFVRNVMGGMLEINKLFEEIAKERGFYSKELITEIAKCGSVQDIDGVPGDIKRVFVTALDISPEWHVRMQAAFQKYTDNATSKTVNLPSDATWGDVKKVFLLAYKLKCKGITIYRYGSKEQVLSLDIPKLMLEEYVCADSEYTGECRICSV

SEQ ID NO: 668 - protein, 862 aa, uncultured archaeon (Rice Cluster I)
  Unc-MetRFS MCM2 precursor
MAASVISSVARWKEFLTRYYKNQIQQLAVSDVKNKALAIEFPNITKFDVRLAEELLNNPDLVLSHAEDALTLVDLPVKTQVSAKIRVIKVPRKTQVRELRSSDVNKLVSLEGTVRKITDVRPRILEAAFECARCKNIIYIPQEGSGKFIEPSYCQCNEEKKGIFRLMYKESRFEDYQRIKIQESPENLKGGEQPQTLDINVSDDLAGIVTPGEFITVTGILRSAQRVNKDGKTAYFDIYLDGVAVELEEQEFDEVEISLEDEEEILRMSRDPEIYQKVIGSIAPSIYGYDEVKEAVAHQLFSGVVKELPDGSRIRGDIHVLLVGDPGIAKSQILRYVVKLAPRGVYASGKSASSAGLTAAAVKDEFDGQWTLEAGALVLADKGIAAIDEMDKMKNEDRSSLHEGMEQQSYHPLTEILLADGRKIRIGDLFDQTYAKADEIIEGIDCEIVPCEGVSVLSTDMNHITEQRVDRVSRHKAPDHFIKIRYSNDREIIVTPEHPVFIVKDGISCIPASAVTIGDPVPAPVEEQTGSKICSLYVTAVEVIPNEGQYRTDYVYDVTVEPYHCFVSQGVILHNSISIAKAGILATLKCRCAILGAANPKLGRFDPYESIPDQINMPPSLMSRFDLIFILQDKPEEKRDTNIAGHILKSHFAGELHEHRKNNPASHVTDDMVRTAMSTIKPQIDPKLFRKYVAYAKRKVFPIMTEDAKAQIINFYLGLRKQGEGDNAPIPVTARQLEGLVRLAEASARMRLSDKVTADDVARTIRITMTSLKQVGMDTETGRLDIDVLQVGVAKSQRDRIKNLKHLIEDLSREYEGSVPVDVLIDRAVESGMPKDKVEKELKKLREIGEIFEPKSGHLSLS

SEQ ID NO: 669 - protein, 519 aa, Vanderwaltozyma polyspora, formerly Kluyveromyces polysporus, strain CBS 2163
  Vpo VMA precursor
ISQSLSKYSNSDAIIYVGCFAKGTEVMMADSSIKNIEDIEIGDLVMGQDGQPREVTQLPRGSDKMYKVNEINENSTSELFSFVCNATHQLIVRTPRNIKVQTRIIDGIECNEIVYTDLFKEITEDARIIELIKEVSKIYPVSEGMDDVQEFVSQYNKSLEDYFQWTVEPRDINRLTESIREATYQVYAPVLYECENLLQYLKNTKYNLNEKSPTALAYLLGLWTGSGMTRRAGLSVSTTDESLMNNIVAAADLLNLKSEFKQERTTTRVGNVNFYGNSTSTNQNVDNLLWDAIQELGFIQDGNKTVPSFLSSDLIEIRETFLAGLIDSNGSVDNNKQDISCTIELEDNKVMSGIVSLIRSLGLKADVTQSSGKLNDVCYNVTVKGGELLKSVLSRCSAINYTKCESRDLLREPVEFYFELQELEEAEYYGITLPEYSDHQFMLSNQVVVHNCGERGNEMAEVLMEFPELFTEMNGKKEPIMKRTTLVANTSNMPVAAREASIYTGITLAEYFRDQGKHV

SEQ ID NO: 670 - protein, 330 aa, Wiseana iridescent virus
  WIV RIR1 precursor
QTRRGSYAAYLDITHPEIISFLNTRRVSGVGGDYNFKLMNIHNAVNIPDEFMRKIWFISTVTPLLRENKYLKIEETIKEIKNSNKWVEFSELKIEDFTPQNSQKFIKEMDKWNLFDPHTKKVKETISATELWERILITRAETGEPYLHFIDASNRNLPSFQKKLGLRVKQSNLCVVGETLILTENGEYPIKSLVDREVSVWNGDEWSDVTVVQTGTDQELLRIDFSNGIFIVCTEYHRFLVLDRSRPIKDLKRKYAKDLPLNFQVMYTHSDLSTTLIKVTKVSKLQRRANTYCFTEQLNNAGVFNGILTSNCSEIILPTDENRTAVCCLA

SEQ ID NO: 671 - protein, 547 aa, Zygosaccharomyces bailii, strain CBS 685
  Zba VMA precursor
ISQSLSKYSNSDAIIYVGCFAKGTEVMMHDGSVKAIETIEAGEAVMGTDGQPRKVVGLPRGREVMYKVSQKTAHRVHKTDETRAAPVALFEYNCNATHKLVVRTPRSCRSITRKMQGVDYNEVIFFDLKKKKLEDGREIEIVKEVSRSYPAAEGAEKAAQMVKDYYDAARGKEFFEWTIEARDVAELGAHVRKATHQVYAPVLYESDFFFHYVKNSKFALRSEASTALAYLLGLWVGDGLSDRAVLSVDSEDSSLLERITGYADILDLSAEYKDREIPKRAKTVCLYPKTIRGNDIRRNLNTDNPVWNAIVDLGYLKDGVKNVPSYLFSDSICHREVFLAGLIDSDGHVRGDDGLSVTIKTIHKTVMEGTVAVARSLGLIVSVNTEEAKIDKNDVNHRFVYAIYISGGDALLSVLAHCAAAKKFRAPPSNEVVRGLKKVFFEMEELKEDDYYGITLAKESDHQFLLANQLVVHNCGERGNEMAEVLMEFPELFTEKNGRKEPIMKRTTLVANTSNMPVAAREASIYTGITLAEYFRDQGKNISMIAD

SEQ ID NO: 672 - protein, 541 aa, Zygosaccharomyces rouxii, strain CBS 688
  Zro VMA precursor
ISQSLSKFSNSDAIVYVGCFAKGTEVMMSDGSIKEVEGIEVGQEVMGKDGKPREVVGTPSGREKMYKVSHKTAHRAHKSDSTSERFGLFEYTCNATHKLVVRTSRSCRPLVRNIQGTDYVEVCLFNMTKKTLEDGRVIDIVEETSDFYPAVEGPEKALRILKEYAEADGGKEYFEWTIEARDVALLSAQVRKATYQLSAPVLLENNHFSHYLKDSNSAVGNDTVRALSYFLGLWIGDGMLNNAATFSVDSQNASLLNRINEFAEVLGLSAEYKDSQEPKRAKTVNLYAKAIRDEGVRKNLDTHNLLWDAIVDLGYLKDDSKNVPGYICSDSFQHREVFLAGIIDSTGYVSDETATVKTIDQSVMTGTVAVARSLGINVSVDVEVDEDGVDRSFVYAIYMDRSDALLAVLANCASNNKQIEAPPHGVIREFNKAYFEMEELEEDEYYGLTLSNESDHQFLLANQLVVHNCGERGNEMAEVLMEFPELFTEVNGHKEPIMKRTTLVANTSNMPVAAREASIYTGITLAEYFRDQGKNISMIAD

SEQ ID NO: 673 - protein, 229 aa, Aquifex aeolicus strain VF5
  Aae RIR2 N-extein
MEKTEKNELVRKLIFNPQGDREASKRKIIKGNPTNIFELNEIKYSWAFDLYKLMGFTNFWIPEEIQMLEDRKQYETVLSDYEKRAYELVLSFLIALDSFQVDMLKEFGRMITAPEVEMAITAQEFQESVHAYSYQFILESVVDPVKADEIYNYWREDERLLERNKVIAELYNEFIRKPNEENFIKATIGNYILESLYFYSGFAFFYTLGRQGKMRNTVQQIKYINRDEL

SEQ ID NO: 674 - protein, 2211 aa, Acidovorax avenae subsp. citrulli AAC00-1
  Aave Hyp-1721 N-extein
MEDQNLKPFDGVLDAPSSGTLQPFSGALDGEEPKRGLKGWGQDIAATAVKGAIAIPEAAVGLADILTGGRVGKFLENEGGAVGFRPKQTREIVNDWHSDATKEAQRKFQEADGIVDKAVTAVQNPSLVVASVGESIPTMIGGGAIGRGLLAATRLGQMGAKGAALAGAAGEGLTMAGSQAEQIRQETPDGLLTPSQAGLAAATGAVGGAVGAVGGRIAQRLGIGDAETMLAQGRSGMARQFADEAAGAAVNPLQQQAVKSIPRHVIEGAIAEGLLEELPQSVAEQIFQNVALDKPWYDQVDSAIVLGALSGGAMGAGAAGYHAAARPRAAAVGEGDPAAARPAGDEPAAEAPARNPGLERVSEAFAEQLRMLQEQEQGEVLGPQSAPPDGAAALAEQRAAAAAQRQADMEASRAVESPDDEIYQSTGAQVPRSVRMGINPADGPLSTGAAMAVDTGVSDQMQQAAALAQAAEAGEKSGKAQKQEQPARSPLGADPETGEIPGSDDVANWSDAQLSEVFRGAQGRDVRIKLAQELSRRKAARAAEQSTPVKGTTDGPQAQPASTQPPAAAQAPAVAAAGAPAQGTLINGGTTTADAGAQAKTAAGAQAAPESKDQRAQRIDAAGQTWTRLPTVQRQVVAEQLKGLKPVLQKNLAGAKWENLNSDLKRKIADLIAPVQEAAAAPAPAPAAPVAMARGTTFPPLDAQPVPAAAEARVPPKAAGTSARAARAAAAPVSAPTVAQAAAQEAATSLSNDLPEPTEAQKLAGNYRKGHARINGHDISIENPAGTRRRPEWPPLQNHYGYIKGTKGADKDHVDVFMTDRAEDSALPVFVVDQVNKDGSFDEHKVVMGAADEAEARSTYLGNYEKGWTGLGGITQMTQDEFKDWVRDPAKTVKPAAAPAAGDALPTAAAEEAGPAPDKDAETAPAPAPALPASESASAAPPAPPAAAETVPQRMKRAKAEKAAAPATPAAAGEASPAAKPKTVPEKMKDAKAKRESKAVREAREAEERRAAYFAPGNVVRGYGGGFDRVVSYQPADADGRWSVTVREVQKDGSGAWADKAGAVERTHGTEPSKVNYATGPAGRMEVDPAPAPAAASHEPSAPARNRDNARKRGPAESEPLFRRYAQDDLGAGMAAELLRIMGKGDGFSPEARLQAVESIRATVSPIVAAWQNAPEVVVAYDLNDPIIPQRVRDADTRQRSGGAHGAPEGFYFGGKAYLMASRLTTPEDAARVLYHEVAGHHGLRGLFGPELDKILNQVATMRRADVDAKMAEYGMRGVDRISRARAAEEVLAEMAEKNPQLSFVQRAVAAIRNFLREHVPGFGSLRLRDADIIQAYILPARNWVERAAAARERGMGSAAMQYSLAQDEARSGFAAEVRAAITAGLNNDERALRAQVPLGIETPAALEALGVVRKPVVTNRNLLAKMHFEHGVPRADLERLGELLSNPVMVFKSDTQPGRMVVVTSLVVRGNPVVVAVDPNGASNRAEVVYVPSAYPKDNADRTFTRWIRDGLLQFANKKESRQLATTARLQLPGVVQRVSGFRANYKTEADLPQTGAGPDVMFSRERIAALKDSALDQITQTMSHPGKVSLWDKTIGTMRHLAERAPAFKPVFESAQRFIDDVSMLGNDAADMAPRLLPRVDSWRDLTKKPITAADNKAVARPLFEGTLMWARDIDGTPVLLDDLTAKYQNLPADQKAQLLLRGGRLDPKILTAWQGLPVGMYEANVNTSFNSRVLKAGVVWSQKELETMFGLDANQVSLYQEGRAAIDRSIDMTARADMLRSLGDEYAGMRDAVLAQETLDDAVELLTRTLMDDARDRPEWSERLMKLNNAVVKAQERAQQLMDEGYAPLSRFGRYTVDVVDAAGDRQYFGMFETKADSNRMKAEMEKQFPGATVTQGTMSQDAFKLFAGVTPESLEMFGSMLGLDGKGDDPKDKAFQAYLQLAKNNHSALKRLIHRKGVAGYSEDVGRVLASFVYSNARLGAGGLNAGTMESAINAIPKEQGELKDLAMGLRDYIANPQEEGQAVRGMLFAQYLGGSVASAAVNMMQPFQITMPWLSQFGGMRKAGAQMARALKDMSRKGFQYEPDLAAAMQSAEEDGVVSPQEIHQLMSQARGTGSLRTGDGTKVGDARAAVANNWERVKVAWGQPFALAEQFNRRSTFIAAYRMAKEQGMAEPSNFARKAVLETQFVYSKANKPRFARGAVGGALF

SEQ ID NO: 675 - protein, 301 aa, Acidovorax avenae subsp. citrulli AAC00-1
  Aave RIR N-extein
MQRDPIDSLAPDAAPRLPEQPISLDVLREKYLKPGEADAETLYRRVARALASVEAPEVREAIEARFLANLRAGAIGAGRIMSAAGTAIQATLINCFVQPVGDCIQGMDEGGYPGIYEALREAAETMRRGGGVGYDFSRIRPRGAEVKGTASMASGPCSYINVFDQSCATVESAGARRGAQMGVLRIDHPDVLDFITAKRTPGRWNNFNVSVGVPDAFVQAVLDDAPWELVHPARPGAALREEGARQRADGQWVYRTLPARELWDTIMRSAYDFAEPGILFLDRVNTDNNLAYCESIAATNP

SEQ ID NO: 676 - protein, 54 aa, Aspergillus brevipes FRR2439
  Abr PRP8 N-extein
FWWTSQRHDGKLWNLNAYRTDVIQALGGVETILEHTLFKATAFPSWEGLFWERA

SEQ ID NO: 677 - protein, 156 aa, Acidothermus cellulolyticus 11B
  Ace RIR1 N-extein
MTEPTSGARAQMDGSGRRGLTMQRIYTTPGVHPYDEVNWVRRDVVMTNWRDGSVNFEQRGVEFPDFWSQNAVNIVTTKYFRGALGTPQREWSLKQLVDRVVKAYAKAGLENGYFATPDDATIFEHELAHALVHQVFSFNSPVWFNVGTPAKQQVSA

SEQ ID NO: 678 - protein, 226 aa, Alkalilimnicola ehrlichei MLHE-1
  Aeh DnaB-1 N-extein
MAQTESSSAATDALKVPPHSIEAEQAVLGGLMLDNNAWDQVADRVTEEDFYRRDHRLIWRAIATLADEGQPVDAVTISEWLKNHELLEAAGGMGYLGALASDTPSAANIKAYADIVRERSVMRQLIRVGTDVVDSAFQPEGRDSKTLLDEAERRIFQIAEQTGRHKQGFRGLKELLPGVVERIDQLYRQDGEVTGLATGFDDFDRMTSGLQNGDLVIVAGRPSMGK

SEQ ID NO: 679 - protein, 892 aa, Alkalilimnicola ehrlichei MLHE-1
  Aeh DnaB-2 N-extein
MAQTESSSAATDALKVPPHSIEAEQAVLGGLMLDNNAWDQVADRVTEEDFYRRDHRLIWRAIATLADEGQPVDAVTISEWLKNHELLEAAGGMGYLGALASDTPSAANIKAYADIVRERSVMRQLIRVGTDVVDSAFQPEGRDSKTLLDEAERRIFQIAEQTGRHKQGFRGLKELLPGVVERIDQLYRQDGEVTGLATGFDDFDRMTSGLQNGDLVIVAGRPSMGKCIMAGSRLVDPRTGGRVTIDELVARQEAEVLTLGDDFRLGMARPAAFVDDGIKPVYRVRTASGREIATTLTHPFLTGDGWRPLSEIGVGEHVAVPRRIPVFGRERLPEHQVKLLAYFLGDGGTTQTSPLFTNADERVRGDFTDAVTAMGGVRCVPVGSPGRTPSLRVSRCRTALQSGRDVFAKALKGAMQQLQLTGEALADALGVSKAAVSGWINARTVPAPATYQRLCATLASSGQALPGTDYADIGKNSPNPVAAFLDRHRLWGRLATEKAVPEVVFRLKRGQLALFLSRLFACDGSAFVQGNGQARISYATSSRALARDVQHLLLRFGILSKLREKRNRYPGLQHAPWELEVMDQASLRAFCEEIGIFSKEEQVRGVREALAGKRRHNNVGGLPWSVSRYVLAAKGERSWGDIYQAAGRVLPEGFNAHLTGRSARRLSRHRASELADLLQDDYLARLATSDLHWDEIVEIEYIGAHQVYDLTVDGTHNFVAEDVCVHNTTWAMNIVEHAAMKQEAPTAVFSMEMPGDSLAMRMLSSLGRVELQRIRSGRLEDDDWPRLTSTLSLLSQAKLFIDDTPGLSPSEMRARARRLKREHGLGLIVIDYLQLMQLPGAKENRAQELSEISRSLKGLAKELDVPVIALSQLNRSLEQRPNKRPVMSDLRE

SEQ ID NO: 680 - protein, 325 aa, Alkalilimnicola ehrlichei MLHE-1
  Aeh Rir1 N-extein
MTTAAKVRALPNATADIPLQSASADIWDKKYRLKSKDGQVIDETVDHTWQRVARALAEVEKTKKLREHWYERFLWALRRGAIPAGRITSNAGAWAHKPATSTINCTVSGTIQDSMDDILQKVHEAGLTLKAGCGIGYEFSTLRPRGAYVSGAGAYTSGSLSFMDIYDRMCFTVSSAGGRRGAQMATFDVGHPDVLDFIRAKREDGRLRQFNLSLLITEEFMQAVEDDAQWPLAFPLTKHEAETDNIDLTDSEQVIWREWPTTEPYISDEQGLVACRIYRTVKARRLWDMIMTSTYDFAEPGFILIDRVNEMNNNWFCEDIRATNP

SEQ ID NO: 681 - protein, 608 aa, Acyrthosiphon pisum secondary endosymbiot phage 1
  AP-APSE1 dpol N-extein
MQNLLFCDLETYSDIPINCGTHRYAENAEILLFAYAYNHAPVKVWDVTQDKTMPADLKAYLDDSEILTVWHNGGMFDTVILKRVLNIDLPLSRVHDTLVQALAHGLPGALGLLCDIFNVNSDKAKDKEGKALISLLCKPRPKNSKIQRATALTHAEEWQRFKDYAGSDILAMREIYQHLPNWNMNVHETELWQLDQKINRRGMCMDVELAKSALTAVENEQKRLSTVTQQLTDNAVQNATQRDALLQHIASAFGITLPDMQASTLQRRINDPDIPPALRELLSVRLQSCTTSTSKYKALLKSVSADGRLRGTKQFCGASRTGRWAGRVFQPDNLPRPTLDPNTIDNGIEALKAGCAELICDDIMQLTSSALRGCIIAPPGKKLVISDLSNIEGRMLAWLAGENWKVNAFSEFDNGKGDDLYKLAYARAFNLLPEDVTKEQRQIGKVMELGLGYGGGVAAFLTFALAYGLDLDELAEAALPNIPPGVKREAMRWYQKSVETDKTYGLSEKIFVTCDSLKRMWRNAHPQTVSFWYDIEDAVKQAIQSPGIAFKCRKLSVRRDKSWLRICLPSGRSLCYPSARIENGQITYMGTNPYSRKWERLKTYGGKS

SEQ ID NO: 682 - protein, 175 aa, Aeropyrum pernix K1
  Ape APE0745 N-extein
MVRVERLRTGVEGFDPLVAGGIPRGFFVAVVGEPGTGKTVFSIHFAYQGVREGDKVIYVTTEESRESVLKQAAMFGMDLGRAVDEGRAIVIDALLKSRSDEWSLEDVSVESLVNKVLEAKRALGYGRARLVVDSMSAFWLDKPAMARKYSYMVKRVLYRWDFTTLLVSQYAITTQ

SEQ ID NO: 683 - protein, 1052 aa, Acanthomoeba polyphaga Mimivirus
  APMV Pol N-extein
MPSETIDSTKQFEFQISDWNSYHELDQEEEEKYVIQLFGRTEDDHDVCLKVTGYTPFFYVEIPKQWKQRQVDKFVEILKNKVQYHCKKNLDEDFDLSKSLIKYAMVKKHKFYNFRNKQLYNFLLLVFKSHTAMKEFSSILARPLEAKGLTNKPMLYQRYESNIEPHIRFMHINNLSSCGWASIDKDKLKKIPEYSNCDYSFSVNWKDVKPSNNDDRMAPFKIMGYDIECVSCDQNFPQAERPSDKIIQIGITMYRYGSMKCYEQHILTLKKCAPIEGVNVECYKKEKGLLRGFAKKIAELRPDFKTGYNNFGFDDKYIYDRILRIDKREGKKQGVNINALKNKFMDEILRTIGKVNNNYLIENEGLDRIPIYTTVKDKKISSKASRFIQIRGGTYVENGNNLKYVQSPGITYFEVKNLSSSALGDNELKFIQIPGVLSIDMMKVIQRDHRLIGYKLDNVSANFITEKADKIIEMPHNQEDSDSEKEDEDTDDKTYDVNIYTKSTKALEKDSYIQIMVNDGYSSSPLSEGAKYKVYDIQTITEKKLNEKTNKEEIFVYQAIKTKICQKDIQQLRETIKNPLLGISWTFAKDDMHHTKINEYFEEGDPKKIRQIAKYCLKDCKLVNLLLAKLEIIVNSVGMAKVCHVPLSYLFLRGQGVKIFSLVSKKCREKNFLIPVLRRKSKDNEGDEDETYEGATVITPKPNVYLSPIGVLDYSSLYPNSMRERNLSQECYVDDSKYDNLPGYIYHDVEIILKDKKGKILRNIDGTPQKEYHRFAQEIITDEQINRELKDIFDKINTVFENNVAIIQNQKYFTEKNISELIDKHKNISDSKIEDIEFDESLSDKRKNKLVDAEKDSLDKNIGFYQKIKSQIDKIKLDSKIEIDNLSKNLNEEEKSKQINKMELNTKNLISKVFSKYLITEQQREELIVLEKERAKRSVNAEKAKVYNTVDGITVRYGILPEILTELLNKRKETNGKLANEKDPFVKAILNALQLAFKVTANSLYGQTGAPTSPLYFIAIAACTTAIGRERLHYAKKTVEDNFPGSEVIYGD

SEQ ID NO: 684 - protein, 226 aa, Burkholderia cenocepacia
  Bce DnaB N-extein
MNAPQDPQIESLKVPPHSVEAEQSVLGGLLLDNAAWDRIADFLSQGDFYRYDHRIIYEHIGRLIASTRPADVVTVYEALTTSGKADDVGGLAYLNALAQNTPSAANIRRYAEIVRDRAVLRRLVSVADEISADAFNPQGKEVRQLLDEAESKVFSIAEEGARGNQGFLEIGPLLTQVVERIDTLYHTANPSDVTGTPTGFVDLDRMTSGMHGGELIIVAGRPSMGK

SEQ ID NO: 685 - protein, 120 aa, Batrachochytrium dendrobatidis JEL197
  Bde-JEL197 RPB2 N-extein
KKRLDLAGPLLGGLFRMLFRKLTKDVSRYLQITMESGREFNLSLAVKSSTITNGPKYSLATGNWGDQKKFMQARAGVSQVLNRYTFASTLSHLRRLNTPIGRDGKLAKPRQLHNTHWGMV

SEQ ID NO: 686 - protein, 30 aa, B.subtilis M1918 (prophage)
  BsuP-M1918 RIR1 N-extein
ESGYPYIMFADNVNKVHPNEHISKVKFSNL

SEQ ID NO: 687 - protein, 380 aa, B.subtilis strain 168 Sp beta c2 prophage
  BsuP-SPBc2 RIR1 N-extein
MTNTIPNWIKLNNEIMIQKDGKYQFEKDKEAVHSYFVDYINQNTVFFHDLKEKLDYLIKNDYYEEEFLSKYTFEQIKSIYKIAYSYKFRFPSFMSAFKFYNDYALKTNDKTKILERYEDRVSIVALYCADGDYEKAVEEVHTMMKQEYQPATPTFLNAGRKRRGEMVSCFLLEVGDSLNDISRAIDISMQLSKLGGGVALNLNKLRAKGEAIKDVENATKGVVGVMKLLDNAFRYADQMGQRQGSGAVYLSVFHPDITDFLDTKKISADEDVRVKTLSIGVVVPDKFIELAREDKDYYMFYPHSVYKEYGQYLDELDINEMYDELVENPRVRKAKGNARKLLEQLAILRSESGYPYIMFADNVNKVHPNEHISKVKFSNL

SEQ ID NO: 688 - protein, 333 aa, Clostridium botulinum phage C-St
  CbP-C-St RNR N-extein
MNIEITLNKGFETKLEELRAKYGEDMFEIEGLGKKQLNTTLFFDKFMNSNNVANASIDDNSNVSDKNITIMLSESKKPLNKLLSRNKLYIEMKENFGKQVADEWLELQINGALYEHDAHDSSLKPYCYAYSLKPVVDKGLYFINDMKAKPAEHLDTYDSHVLEFIAYATNLQSGAVGIPDYLIYAFYFWKKDIENGVVTKEQANKYREQHWQKMLFSLNQPYLKGGEQSAYTNFSILDREHILGFFGMEKFPDNTLIIDYIDEIIQYQKDFLDYEKKLRYEKFFTFPVISASLLYKNDKFVDEDMARFINKHNMTWQDVNIYKATSIDALASC

SEQ ID NO: 689 - protein, 333 aa, Clostridium botulinum phage D
  CbP-D RNR N-extein
MNIEITLNKGFETKLEELRAKYGEDMFEIEGLGKKQLNTTLFFDKFMNSNNVANASIDDNSNVSDKNMTIMINESRKPLNKLLSRNKLYIEMKENFGKQVADEWLELQINGALYEHDAHDSSLKPYCYAYSLKNVVDKGLYFIKDMKAKPAEHLDTYDSHVLEFIAYTTNLQSGAVGIPDYLIYAFYFWKKDIENGVVTKEQANKYREQHWQKMLFSLNQPYLKGGEQSAYTNFSILDREHILGFFGMEKFPDNTLIIDYIDEIIQYQKDFLDYERKLRYEKFFTYPVMSASLLYKNDKFVDEDMARFINKHNMTWQDVNIYKATSIDALASC

SEQ ID NO: 690 - protein, 389 aa, Coxiella burnetii
  Cbu DnaB N-extein
MPPRQKVKTSVPKVPPHSQEAEQSVLGALMLDNRAWDRIADRISIQDFYRSDHQLIFETMSRLVDQHKPLDVLTIAEALKAREQLSAAGGEPYLYELAKNTPSAANIVAYADIVRERAILRQLIEAGTDITHDGFNPDGRDIKELLDTAEQRVFHIAESRVRGSGPIAIGPLLTKATDRIDKLFHSKQAITGLSSGFTDLDKLTSGLQDGDLIVVAGRPSMGKTVFAINIAEVAAIKGNIPVLVFSMEMPAESLVMRMLSSLGSIDQHKVRTGQLKDDDWPRITHAIEMLSETKLFIDDTPALTPSEIRSRARRLAREHGGLGLIVIDYLQLMHVPGTKENRSTEISEISRSLKALAKELNVPVVALSQLNRSLEARVDKRPVMSDLRE

SEQ ID NO: 691 - protein, 453 aa, Chlorobium chlorochromatii CaD3
  Cch RIR1 N-extein
MKIERLFTQAGNNVFDAFEYSLRSSVLRNTDGSVVFEMNDIEVPVQWSQVATDILAQKYFRKTGVQQRDAEGNVLLDSEGNPLLGSERSLKQVVHRLAGCWREWGEKHGYFDTPDDAQAFYDEVAFMILAQMGAPNSPQWFNTGLNFAYGTTGPAQGHFYVDPATGEVTESGDAYSRPQAHACFIQSVNDDLVNDGGIFDLAIREARVFKFGSGSGTNYSSLRSSGEKLSGGGSSSGLMSFLKIFDSAAGAIKSGGTTRRAAKMVIVDIDHPDVEKFIEWKAKEEDKVASLVAGSRICSRFLQAIVEEALANGADRKTNPRLQQLIQNALSRGVPMSYVIRVLALVEQGYTSLDFNEYDTHYESEAYQTVGGQNSNNTVRVTNAFMLAVANDEVWELRQRTTGKVSRVVKARELWEKILLSAWKCADPGLQFDTTINEWHTCPQSGRINASNP

SEQ ID NO: 692 - protein, 447 aa, Chlamydomonas eugametos (chloroplast)
  Ceu ClpP N-extein
MPIGVPRIIYCWGEELPAQWTDIYNFIFRRRMVFLMQYLDDELCNQICGLLINIHMEDRSKELEKKEIERSGLFKGGPKTQKGGTGAGETGASSIQNKKSNSSSFEDLLAADEDLGIDENNTLEQYTLQKITMEWLNWNAQFFDYSDEPYLFYLAEMLSKDFNKGDARMLFSNNNKFSMPFSQMLNTGSMSDPRRPQSTNGANWNSSEQNNSLDIYSPFRMLANFEAQDYDFKQINPSLASKEEVFKLFNNTILKNGGQRNNNMSKLLTELAQRNWENKTNSQENLYKSTEKALSQRNLRKEYIKDRTLNNYSSDPFNTKGYVNAQGASTGPSPRTRGMHADGSLNYLDFYSYNDSYNDFKTAPRGKQAERAFQEEESKKVFVIINSFGGSVGNGITVHDALQFIKAGSLTLALGVAASAASLALAGGTIGERYVTEGCHVMIHQPE

SEQ ID NO: 693 - protein, 276 aa, Candida glabrata
  Cgl VMA N-extein
RKELKRLSLDDEAGESQYGAIYSVSGPVIVAENMIGCAMYELVKVGHDNLVGEVIRIDGDKATIQVYEETAGVTVGDPVLRTGKPLSVELGPGLMETIYDGIQRPLKAIKESSQSIYIPRGIDTPALSRDIKWQFTPGTFKTGDHISGGDIFGTVFENSLVESHKILLPPRARGTITWIAPAGEYTVDEKILEVEFDGDKYDYTMFHTWPVRVPRPVAEKLSADYPLLTGQRVLDSLFPCVQGGTTCIPGAFGCGKTVISQSLSKYSNSDTIIYVG

SEQ ID NO: 694 - protein, 271 aa, Chilo iridescent virus
  CIV RIR1 N-extein
MSDIIIDLSRDSKFDELGLKRLRESYMMREETSPQERFAYVCKQVGTDRDHSQRLYEYTSKHWLSLSTPILSFGKANHGLPISCYLSWIEDTKEGLIDTLSEVNQLSMLGGGVGVGVGIRTSDNKSTGVMSHLNTYDACSLAYKQDGVRRGSYAMYLNNNHPDVLQFIEMRKPTGDHNIRCLNLHHGLNISDEFMELIEKCDGGGNIDDTWNLIDPHTKKITTVGARDLWQRILETRMKTGEPYICFIDTCNKHMYDFQKKKGLTIKQSNL

SEQ ID NO: 695 - protein, 59 aa, Cryptococcus laurentii strain CBS139
  Cla PRP8 N-extein
MKSNPFWWTNQRHDGKLWALNNYRVDVIAALGGVEGILEHSLFKGTAFPTWEGLFWEKS

SEQ ID NO: 696 - protein, 34 aa, Filobasidiella neoformans (Cryptococcus neoformans) Serotype A, PHLS_8104
  Cne-A PRP8 (Fne-A PRP8) N-extein
DVISALGGVEGILEHSLFKGTAFPTWEGLFWEKA

SEQ ID NO: 697 - protein, 47 aa, Cryptococcus neoformans (Filobasidiella neoformans), Serotype AD, CBS132).
  Cne-AD PRP8 (Fne-AD PRP8) N-extein
HDGKLWQLNNYRVDVISALGGVEGILEHSLFKGTAFPTWEGLFWEKA

SEQ ID NO: 698 - protein, 1530 aa, Cryptococcus neoformans var. neoformans JEC21
  Cne-JEC21 PRP8 N-extein
MSTVPPGFGAPPPGFTPQPNGNGDGMEGDFFGQLSQEEIDKKARKWRQSQKRRFNSKRRQGGGGGVDFGKADLPPEHIRKIIKDHGDMSNRKFRNDKRVHLGALKYVPHAVMKLLENIPMPWEQVREVPVLYHISGAITFVNEVPRVIEPVYHAQWASMWLAMRREKRDRRHFKRMRFPPFDDEEPPMDYGDNVLDVEPLEAIQLELDEEDDEAILEWFYDPKPLVDTPQVNGSSYKYFQLALPQMANLYRIGRQLLSDYSDNNAFYLFDKKSFFTAKALNIALPGGPKFEPLYRDMDAFDEDWNEFNDINKIIIRNVIRSEYKVAFPHLYNSLPRSVYIGVYHEPKNVYIKTDDPDLPAFYFDPLINPISQRVVQEAHTPLVSHEDQVFGFGNDEDVEFELPEEVEPFLGERDLENENTSDAIALYWAPYPYNLRSGKMKRAQDVPLIKNLYLEHCPDGQPVKIRVSYQKLLKVYVLNALHNKPPKAMVKRNLFRSLKNTKFFQATTLDWVEAGLQVCRQGYNMLNLLIHRKNLNYLHLDYNLNLKPIKTLTTKERKKSRFGNAFHLCREILRLTKLIVDAHVQFRLGNVDAFQLADGLQYMFAHVGQLTGMYRYKYKLMKQIRMCKDLKHVIYSRFNTGPVGKGPGVGFWAPGWRVWLFFMRGIVPLLERWLGNLLARQFEGRNSKGIAKTVTKQRVESHFDLELRAAVMHDILDMMPEGVKQNKAKTILQHLSEAWRCWKANIPWKVPGMPAAIENIILRYVKSKADWWTSVAHYNRERIRRGATVDKAVVRKNLGRLTRLYLKAEQERQNGYLKDGPYITSEEGTAILISTAHWFESRKFAPIPFPPLSYKHDTKLLVLALEKLKEAYSVHGRLNQSQREELALVEQAYDNPHECLSRIKRLLLTQRAFKEAGIEFFDTYDKLIPCYDVEPLEKLSDAYLDQFLWYEADKRRLFPSWVKPSDSEPPPLLVYKWCQGINNLTDIWDTSEGESVVMMETVLARVYEKVDLTLLSRLLRLIMDHNLADYITSKNNTTLTFKDMSHINTYGMIRGLQFSSFVFQYYGLVLDLLILGLERASEIAGLPEAPNGFLQFKNREIETKHPIRFYSRYVDRIHMLFRFTAEESRDLIQRYLSVQPDPNNENVIGYNNKRCWPRDCRMRLIKHDVNLGRAVFWNVKNSLPRSLTTIEWEDTFVSVYSKDNPQLLFSMCGFEVRILPRVRTQHGEAYSLKDGVWNLTQESTKERTAQAFLRVSDQGIQDFNNRIRQILMSSGSATFAKIINKWNTCLIGLMTYYREAVVHTNELLDSLVKAENKVQTRVKIGLNSKMPSRFPPCVFYSPKELGGLGMLSMGFVLIPQSDLRWSKQTDSGGITHFRSGMTHEEDQLIPNLYRYLQPWEAEFLDSARVWSEYALKRKEATASNRRLTLEDLEDSWDRGIPRINTLFQKDRHTLAYDKGWRVRQYFSQFFRLRNQPFIWTNQRHDGKLWQLNNYRVDVISALGGVEGILEHSLFKGTAFPTWEGLFWEKA

SEQ ID NO: 699 - protein, 67 aa, Clostridium thermocellum
  Cth TerA N-extein
MYDEAKAQHAVNFINCLKHTKGQWRGVPFDLLPWQDKIIRDIFGTVKENGYRQYNTAYVEIPKKNGK

SEQ ID NO: 700 - protein, 283 aa, Candida tropicalis (nucleus)
  Ctr VMA N-extein
MAGALENARKEIKRLSLDDTNESQYGQIYSVSGPVVIAENMIGCAMYELVKVGHDNLVGEVIRINGDKATIQVYEETAGVTVGDPVLRTGKPLSVELGPGLMETIYDGIQRPLKAIKDESQSIYIPRGIDVPALSRTVQYDFTPGQLKVGDHITGGDIFGSIYENSLLDDHKILLPPRARGTITSIAEAGSYNVEEPVLEVEFDGKKHKYSMMHTWPVRVPRPVAEKLTADHPLLTGQRVLDSLFPCVQGGTTCIPGAFGCGKTVISQSLSKFSNSDVIIYVG

SEQ ID NO: 701 - protein, 436 aa, Chlorella virus NY2A infects Chlorella NC64A, which infects Paramecium bursaria
  CV-NY2A RIR1 N-extein
MVGRPMNRLMVVLKRDGSKENISFDKILQRIQRLCWPINSKPVYKGSRAMTGLSVDVSKIVASVCASIVDGISTVQLDELTADKSASMTTEHPDYGILAARISVSNLQKQTHDKITDAYAEIAHLLSNDFKENIEKHADEYQSFIDYDRDYDFDYFGFKTMERLYLTKVNNKIVERPQHVYLRVAIGLWGSDIARVKETYDALSCRKFTHASPTLFNAGFKKAQLASCFLVTVEDSLGDIYKVLGDCAQLSKHGGGLGINISEIRGRGSRINGTNGESDGIVPMLKVFDTTSAYANQGGRRKGSFAIYLEPHHSDVMDFLLMKRNQGEESLRARNLFYAVWLNDLFMKRVETDAQWSLFDPSECPGLTDAFGDEYAELYERYEAEGKAKNVVKARDVWNTMVTTIIETGQPYVSNKDAVNKKNMQMNAGTIRGSNL

SEQ ID NO: 702 - protein, 453 aa, Crocosphaera watsonii WH 8501 (Synechocystis sp. WH 8501)
  Cwa PEP N-extein
MITTTYEITPTVKRETAFILWFEEVGSKDVDLVGGKNSSLGEMIQQLQPKGVNVPTGFATTAHAYRYYIESAGLESRLRDLFTDLDVNDVTNLQERGQLSRSLILNTPFPKELEAAIIEAYKMLCDRYSHECSKLQEKYREECKIETQNLDVAVRSSATAEDLPEASFAGQQETYLNIHSVKGVLEACHKCFASLFTDRAISYRHHNGFDHFAVALSVGVQKMVRSDLASAGVMFSIDTETGFKNAALITAAYGLGENVVQGAVNPDEYYVFKPTLQDGYRPILEKRVGTKAIKMIYDTGGSKLTKNVDVLPEEQEQFCLNDEEILKLANWACIIEDHYSRVRETYTPMDIEWAKDGRTGELYIVQARPETVQSQKAANVLKTYKLQDHSTVVAVGRSVGASIGQGEARVILEASKIDQFKPGEVLVTNRTDPDWEPIMKKASAIVTNQGGRT

SEQ ID NO: 703 - protein, 462 aa, Crocosphaera watsonii WH 8501 (Synechocystis sp. WH 8501)
  Cwa RIR1 N-extein
MQPTVLTSPKQTSHGDTQTSSLYHSQLGESKIRVRRRDGSWTALNIVKIRAVVDWACADREVNSIALEAGLTTRLRDGITTREIQDNLINCALEMCSPDEPDWRYIAGRLHIWSLWKDTLVSRGYQYGNYEIVAKTKIDAKQYDNRLLTYSTAELQEAGSWINPDWDTDYDYAGAVLLTSRYLLDDELPQEAFLTCALLLATVESPENRLPWAKRFYEAIAKGKVSLATPILANLRVPGGSLTSCFILSIDDNLESIFEEITNTARISKNGGGVGVNVSRIRATGSWVMGKNNASGGVIPWIKLLNDTAIAVNQGGRRAGAVTVGLDIWHLDVPEFLEIQTENGDQRRKAYDVFPQLILTDEFMRRVENKEEWTLVDPYQVKEKLGIELAELWGEKFEEAYGLIEAELDREITLYKRVNARELFKTIMRSQVETGMPYLAFKDTINKANPNKHVGYIPGVNL

SEQ ID NO: 704 - protein, 161 aa, Costelytra zealandica iridescent virus
  CZIV RIR1 N-extein
PEIISFLNTRRVSGFGGDYNYKLMNIHNGVNIPDNFMRKIWFISTVAPILKQENGKRMKMLEEAIKTFQNSDKWVDENNLDLNKLTIENAQTYIKEMDKFDLTDPHNKEVKETISATELWERILVTRAECGEPYCHFIDTSNRKLPEFQKKLGLNIKQSNL

SEQ ID NO: 705 - protein, 505 aa, Dictyostelium discoideum strain AX4 (nucleus)
  Ddi RPC2 N-extein
MDPESVGYCNNPDFLHKGSMDELYNISKLTDDIKPVEEKWKLVPAFMKCRGLVKQHIDSFNFFINVEMKKIVKANERLTAENDPSYFVRFTDINVGSPTSTEDNLDSVQLTPQRCRLRDMTYSAPIFVNIEYTRNKQIISKRDVHIGNIPIMLRSSNCVLSKKTPEQMAALGECPMDPGGYFIVRGQEKVILNHEQLSKNRIIIEMDSKGLPSASVTSSTHERKSRTGVTLKNEKLYLKHNTFGEDIPVAIVLKGMGVETDQEMAQLVGSDDVFLNAITPSLEECQKCGVHTAAQALDYLGSRIKVFRRPYGVQNKKTKSEEARDILAGVVLNHVPVRRYNFRLKVIYLSLMIRRIIMASKDKSCLDDKDYYGNKRIELSGQLISLLFEDCFKKFQSELKKSVDQAIAKANRAENLDLPKLIRTDTITNGFTHAISSGQWNLKRFRMERSGVSQVLSRLSYISCMGMMTRIQSQFEKTRKVAGPRSLQPSQWGMLCPSDTPEGEA

SEQ ID NO: 706 - protein, 215 aa, Deinococcus geothermalis DSM11300
  Dge DnaB N-extein
MELTPRVPPHSNEAEISVLGSILLDNDTLIGLGDTLTPEMFYREGHRKIFAAMRALQERGEPVDLVTLSEHLRVQGQLDEVGGLTYLIGLSEQVPTAAYAEHYARIVQEKHTLRQLISASGKAMQLAYEGQLPLEDLLDRAEKMIFEVAEQKKKSEAFQAMGEVVHETFEYITLLHQNRGIPDGVSSGFRDLDEQISGFQKGSLNVLAARPSMGK

SEQ ID NO: 707 - protein, 241 aa, Desulfitobacterium hafniense DCB-2
  Dha-DCB2 RIR1 N-extein
MLYRVASIIAQVEETFGKTKKEVKELAKSFYEMMAKLEFMPNSPTLMNAGRDLGQLSACFVLPVEDSMEEIFDAIKSAAIIHKSGGGTGFSFSRLRPKNSTVRSTGGVASGPVSFMKVFNAATEAVKQGGTRRGANMGILRVDHPDIREFITCKEDNKEITNFNISVGITEEFMKAVQEKRHYNLIDPHTKEADGQLYAPEVFQLIVDHAWRNGEPGIIFLDRLNRDNPTPQLGEIEATNP

SEQ ID NO: 708 - protein, 283 aa, Desulfitobacterium hafniense Y51
  Dha-Y51 RIR1 N-extein
MSFQESAPKAWLKANLTPNARVILEKRYLKQENGEVAESPEDMLYRVASIIAQVEETFGKTKKEVKELAKSFYEMMAKLEFMPNSPTLMNAGRDLGQLSACFVLPVEDSMEEIFDAIKSAAIIHKSGGGTGFSFSRLRPKNSTVRSTGGVASGPVSFMKVFNAATEAVKQGGTRRGANMGILRVDHPDIREFITCKEDNKEITNFNISVGITEEFMKAVQEKRHYNLIDPHTKEADGQLYAPEVFQLIVDHAWRNGEPGIIFLDRLNRDNPTPQLGEIEATNP

SEQ ID NO: 709 - protein, 1183 aa, Debaryomyces hansenii CBS767
  Dhan GLT1 N-extein
MASYLPQEEFETNVYKYDETPENKSWASTLPTAKGLYNPEYEKDACGVGFTCHIKGEASHKIVSDCRNLLCNMTHRGGELNPKDGDGAGLLSSLPHKFFLREFKYYCNIDLPKLGQYGTGNIFFKKDDIVFEKSRKTFESIANTLGLKVLGWRKVPHDSSILGPASLSREPLILQPAIVLSELFDGQHKEISEEEFEKNYQMDFEKKLFILRKQSTHTIGLHNWFYICSLSSKTIVYKGQLAPNQVYAYYHDLANAEYEAHFALVHSRFSTNTFPSWDRAQPLRWAAHNGEINTLRGNKNWMRAKEGVMESELFGDELDKLYPIIEEGGSDSAAFDNVLELLVINGVLSLPEAVMMLIPEAWQNDIHIDSKKKAFYEWAACLMEPWDGPALFTFADGRYCGANLDRNGLRPCRYYVTDDDRMICASEVGVIEIEPEKILQKGRLQPGRMLLVDTKEGRIVDDRELKNKVASRFDFKSWVLANMISMDDLFSKLESRNVNLIENPESQDITVQTDPRLVAFGYSHEQISMVLAPMAEAKEALGSMGNDNALACISEQPKLLYDYFRQLFAQVTNPPIDPIREEIVMSLECYVGPQGNLLEMKPDQCNRLLLKSPVLSSLELNAIKNIEKVYPKWSVTNIDITFDKAEGIQGYINKIDNICQASSKAIADDHQIIILSDKLTSFNRIPISALIATGAVHHHLVRQKQRSKVAIIIETAEAREVHHACCLVGYGADGINPYLALETLVRMNIENLLKASLTDDQIIKNYKIAVDSGILKVMSKMGISTLASYKGAQIFEALGVDNSVIDRCFAGTASRIKGITFEYIAQDAFSLHDVGYPSRETIKPVALPETGEYHWRDGGDSHINEPAAIASMQDAVKNKNEIAYEAYSKKEYEAIKKCTLRGLLDFDYENSQSIPIDQVEPWTEIVRRFFTGAMSYGSISMEAHSTLAVAMNRLGGKSNTGEGGEDSARSLVHSNGDTMRSSIKQIASGRFGVTSHHLSDADELQIKMAQGAKPGEGGELPGHKVSEQIGKTRHSTPGVGLISPPPHHDIYSIEDLKQLLYDLKCSNPRARTSVKLVSEVGVGIVAAGVAKAGSENILISGGDGGTGAAKLTSIKYAGLPWELGLAESHQTLVLNDIRGRVILQTDGQLRTGRDIAVAALLGAEEWGFATTPLIALGCIMMRR

SEQ ID NO: 710 - protein, 271 aa, Debaryomyces hansenii CBS767
  Dhan VMA N-extein
MNRLSLDAGESEYGQIYSVSGPVIIAENMIGCAMYELVKVGHENLVGEVIRIAGDKATIQVYEETAGVTVGDPVLRTGKPLSVELGPGMMETIYDGIQRPLKAIKEKSQSIYIPRGIDAPSLSRTAQYDFTPGQLKVGDHITGGDIFGSVFENSLLDDHKILLPPRARGTITSIAEKGAYTVEDPVLELEFDGKKHSYSMMHTWPVRVPRPVAEKLAANHPLLTGQRVLDSLFPCVQGGTTCIPGAFGCGKTVISQAISKFSNSDLMVYIG

SEQ ID NO: 711 - protein, 286 aa, Desulfovibrio vulgaris subsp. vulgaris DP4
  Dvul ParB N-extein
MLQTETWPIDRLIPYVRNPRKNDEQVDRMVSAIKEFGFRIPVVAKSDGTVVDGHLRLKAAQRLGMTEVPVALADELTEAQVKAFRLLANRSANWAAWDNDLLALEMEELQAMAYDTSLTGFDIAEVDALLAKPAKDGLTDPDEVPETPTEPASAIGDVWILGKHRLMCGDSTNAEHVARLLAGVQPHLMVTDPPYGVAYDPAWRNEALAGQKTRRTGTVLNDDRADWREAWALFPGDVAYIWHGALHAATVAESLAACGFSIRSQIIWSKERLVLSRGHYHWMHEP

SEQ ID NO: 712 - protein, 1525 aa, Emericella nidulans (anamorph: Aspergillus nidulans) FGSC A4
  Eni-FGSCA4 PRP8 N-extein
MASLPPPPPPGWGASAPPSMPLAPPPPGYQPPADPNVAKYAQKKTEWLRTQRNRFGEKRKGGFVETQKADMPPEHLRKIVKDIGDVSQKKFTNEKRSYLGALKFMPHAVLKLLENMPMPWESTREVKVLYHVNGCLTLVNETPRVIEPVFHAQWATMWVCMRREKSDRRHFKRMRFPPFDDEEPPLSWSENIEDVEPLEPIQMELDESEDSPVYEWFYDHRPLLDTPHVNGPSYRKWNLDLPQMATLYRLSHQLLSDVVDQNYFHMFDLNSFLTAKALNVAIPGGPRFEPLYKDIDPNDEDFSEFNAIDRIIFRAPIRTEYRVAFPFLYNTLPRSVKVSWYSHPQVVYVRTDNHPNLPAFYFDPVINPISSRSVAPKNITVSHEDEIFGPGGYEDDFELPAEVEPFFADEDLYTPETASAIALWWAPHPFNKRSGKMVRAQDVPLVKHWYLEHCPQGQPVKVRVSYQKLLKTYVLNELHRKKPKAQNKQDLLKTLKSTKFFQQTTIDWVEAGLQVCRQGFNMLNLLIHRKNLTYLHLDYNFNLKPVKTLTTKERKKSRFGNAFHLMREILRLTKLIVDAQVQYRLGNIDAFQLADGILYAFNHVGQLTGMYRYKYKLMHQIRSCKDLKHLIYYRFNSGPVGKGPGCGFWAPAWRVWLFFMRGIIPLLERWLGNLLSRQFEGRHSKGVAKTVTKQRVESHFDLELRASVMADLMDMMPEGIKQNKVNTVLQHLSEAWRCWKSNIPWKVPGLPAPIENIILRYVKSKADWWISVAHYNRERIRRGATVDKTVAKKNLGRLTRLWLKAEQERQHNYLKDGPYVSSEEAVAIYTTMVHWLESRKFSPIPFPSVSYKHDTKILILALERLRESYSVKGRLNQSQREELALIEQAYDSPGTTLARIKRFLLTQRAFKEVGIDMNDNYSNINPVYDVEPIEKITDAYLDQYLWYQAEQRHLFPAWIKPSDSEVPPLLTYKWAQGINNLSNVWETADGETNVMIETELSKVYEKIDLTLLNRLLRLIMDHNLADYITSKNNVQLSYKDMNHTNSYGLIRGLQFSGFVFQFYGLMIDLLLLGLQRASEMAGPPQSPNDFLQFRDRATETRHPIRLYTRYIDKIWVFFRFNADESRDLIQRFLTENPDPNFENVIGYKNKKCWPRDCRMRLMRHDVNLGRAVFWDLKNRLPRSITTIEWDDTFASVYSKDNPNLLFSMSGFEVRILPKCRNLNEEFSVKDSVWSLVDNSTKERTAHAFLQVTEEDIQKFNNRIRQILMSSGSTTFTKIANKWNTALIALFTYYREAAVSTVNLLDTIVKCETKIQTRVKIGLNSKMPSRFPPAVFYTPKELGGLGMISGSHILIPASDKRWSKQTDTGITHFRAGMSHDEETLIPNIFRYIIPWEAEFIDSQRVWMEYSQKRMEAQQQNRRLTLEDLEDSWDRGLPRINTLFQKDRSTLSFDKGFRLRAEFKQYQLMKSNPFWWTSQRHDGKLWNLNAYRTDVIQALGGVETILQHTLFKATAFPSWEGLFWEKA

SEQ ID NO: 713 - protein, 437 aa, Ferroplasma acidarmanus, taxon:97393 and taxon 261390
  Fac-Fer1 RIR1 N-extein
MNKVLNTVIKRDGSSVPFDKKKIAMAIFKAMLSVKIGSMEEANKLADYVAQELETSSEVPTVELIQDTVEKVLMTRRINDVSYIAAAKAYILYREKRNTIRQEKEFIGVKDDLKLSLNAVKVLEARYLFKDSEGKIIETPKQMFHRVAVHLGIIQGLYDYISYRKTGKLNEKGTVYSGITKTQNEELERAFNELKKEKAIDGTYTEFIDFIKTKKNMINYWIEKFENMMIKLEYVPNSPTLMNAGGPLGQLSACFVLPVDDSIDSIFDTLKATAEIHKSGGGTGFSFSRLRASDDIVASTKGVASGPVSFMRIFDVTTDVIKQGGKRRGANMGILNYNHPNIMDFINSKDAENKILSNFNISVGVNDEFFEKLDNDENVDLINPRDGKVTGRVKATTLWNSIIDHAWLTADPGMIFLDEINKKNPVKNIGYIESTNP

SEQ ID NO: 714 - protein, 245 aa, Ferroplasma acidarmanus
  Fac-Fer1 SufB (Fac Pps1) N-extein
MIKMEDYNKDEEIEKLTESLKHNKKSDFEFHDTINPVYSTGTGLNRKTVEEISDIKHEPDWMRRSRLKALDIFLSKPMPTWGPDLSGINFDELTYYSKPGETKAKNWDDVPDKIKETFNKLGIPQMEQKYLAGSVAQYDSEGVYGSLRKEWEDKGVIFTDLDTAVQEHPDLVKDYYCRAIPPSDNKFAALNGAVWSGGSFLYVPKNVTIDMPLQTYFRMNGEQSGQFEHTIVVADEGAKVHYIEG

SEQ ID NO: 715 - protein, 256 aa, Frankia alni ACN14a
  Fal DnaB N-extein
MAWPVDRSPDVYEHVFESGSAGERGGCVVSVTEISRGGAGGGAEFERTPPHDLPAEQSVLGGMLLSKDAIADVVEVLRMADFYRPAHGLVYEVIGDLYGRGEPADVISVAAELSRRDLLERVGGPGYMHTLISSVPTAANAGYYARIVAEKAVLRRLAEAGTRIVQLAFGAAPDVSDVVDRAQAAVYEVTERRANDDYLPLGELLNPALEEIESIQGRGEGALTGVPTGFVDLDELTNGLHGGQLWIVAARPAVGK

SEQ ID NO: 716 - protein, 376 aa, Guillardia theta (plastid)
  Gth DnaB N-extein
MKVTKFYNLKAEKHLIIQILVEKDFFLQIYTKIDTQVFYFQSHQILYRSINILHTKKVLINLPNLLSLLHSELVSETVINYLITLFNDRDNFRILNINDSLKVLLDNFIRRELQNSCAKIVSLTFNFNLSVETLLQKSNLLISNINTYNKKVSLKSISQLLLETILEIDKKTNRSTHVLTGFFDLDHILVGLQKSDLIIIAGRPSMGKTAFMLSLVRNVADIQSFPIVIFSLEMSSKQLIYRLISNETNIATSRLREGNISISEWEILNRAMTILSNLNIYLDDENNLDVLDIQSKLASLQQIYGDIGLIVIDYLQLLQYKEKSSQRHIELSYITRYLKLIAKDFNLPLVVLSQLSRNVEFRLNKRPILSDLKESG

SEQ ID NO: 717 - protein, 221 aa, Gloeobacter violaceus, PCC 7421
  Gvi DnaB N-extein
MTSSELDLRIEERLPPQNIDAEETILGGLMMDPEALTRVVEHLRPEAFYVESHQIIYRAALALHAQGRPTDLLTLSAWLEDNKLTEKIGGRTYLRRLTDAAINTINIDGYGRLVSDKYALRMLIRAGQEIAALGFDSATEIPKLLDRAEQTLFAVTQERVQRSLVPASEVLMNIFEQLETRYQDGSNVFGIPTHFYDLDNYTQGLQPSDLIIVAGRPGMGK

SEQ ID NO: 718 - protein, 755 aa, Gloeobacter violaceus, PCC 7421
  Gvi RIR1-2 N-extein
MFVIAQLHLAPLDAELVIRLFAGASTMGMDGVGSLEQGMALSESQRAVLQKYLIGEERTWEDVCRRVARFVAGAEKTPALQREWQERFFSILAPMKMLPGGSILANSDHGTHGLLNCFVLSAEDNIQEIAKLVTDAVLTTKFRGGVGINIGAHGQKGYIRPKGTPFADGKALGPCAVLDMVSETSKKITTGNKCFAAGTLLHTEQGYVPVEQVVAGVGTRVCTHQGFRNISERFDNGEAEVFRVTTRKGYSVEVTANHKMARLDENGDLLLDELSHLQVGDNLLLLLGSNPVTEKVRLQCIPAGYRSSIEIAQPPELDEQLAYLLGYAYGDGCVGRGATYNYLSLAVSHTYPNVRDQLAAIIREKFGLTTKIYSGSGAVWNLLVHSANLLDWLKANGLLKQKAADLAMPEAILRSPSSVVGAFLSGYFDADGCVRGGKGGYGFDCTSKAFVGAVQLLLLAEGIVSNLHTTDRSRQGWRTIYRLNVCGTEFKRRFQTLCCRSAKVVHSPMVLGRDGTGGYPPALVRGASYQRVVAVGGKHLLYTALLKVIEKTRTAGKQALAESLCQHVNYFPDPIVAIESVGTQRVYDIEVEGMHLLSGNGIYTSNSRRGAFMFSMHWKHPDVWEFIQAKTQSVMDARVARDLIERTADLAVDKGLSDVEKNARLDQLKQELTDTWTETHLSPKGTRDRRWHNANISVLVDDEFFDKLDEGNPGVVDLWNQIAQYAHDTADPGLLLSDNARRRSPIKNFITTTNP

SEQ ID NO: 719 - protein, 646 aa, Heterosigma akashiwo virus 01
  HaV01 Pol N-extein
MEIIECQVFSFYPTDFLNNRNFTVFAFGRKEDGSSVGIEIVDFKPFMYLHVPERQQKFWTMNNTEDLRKTLVTEHEIKELRNINTVMKKRLFPYTNKDRELFLMLEFNTEWGIRKCSMSLRENYIYKNFDVYESNISPMLRLMHMREILPSGWVRIKNYDQNNTTKCDTNIRINFMDIIGFERDDIAPCKISSFDIECMSFDAYTQNQSIFPSYERENDTISQIGMATWSYGNNEEVLKRLYTLGNAAEPTDQTIDIIQCDNEGELIIRWFHYIAEIDPDIITGYNIFGFDWEYIKGRVDFLGIEDEILSVASRIDKLKSRFMTKELNSSAFGDNEFKFLEMPGRIEFDFFSYIKREHKLESYKLDNVAYHFTKQKKHDVKPMDIFIKLMGTPEDVREVAEYCVQDTFLIIELMKKLCVIPNLIEMSKVTRVPFEYLILRGQQIKVFSQIFYEAMKENIVIPTNILKLQGKKDRNEEHEKYTGATVLTANSGCYFDCVSGLDFASLYPSIMIAYNMCYTTLVLNERELPREAKIETIEWENNRHRFVQNKEGLLPKILKKLWITRKSTKRLMNETENKEMKTILNGKQLAIKVSMNSVYGFCGVMRGILPCVAIASSVTTKGRQMIEHTQNMVKQLYPDAKVIYGD

SEQ ID NO: 720 - protein, 225 aa, Halorhodospira halophila SL1
  Hhal DnaB-1 N-extein
MQGDGSASDSEALKVPPHDLEAEQAVLGGLMLDNAAWDQVADRLHEEDFYRREHRLVYRAMGELAEGNHPMDVVTLSGWLRQQGKLEEAGGLSYLGGIARETPSAANIRAYADIVRERSVLRQLIRAGSDVAEAAFRPQGRNSEDLLDYAEQTIFQIAEQTGRNRQGFVGMRQLMPQVIDRIDTLYHTQEAVTGLATGFDDLDHMTSGLQDGDLVIVAGRPSMGK

SEQ ID NO: 721 - protein, 331 aa, Haloarcula marismortui ATCC 43049
  Hma CDC21 N-extein
MATAENTELIDRFEEFYRNYYRNEIGELAQKYPNDQKSLYIDWDDLYRFDPDLADDYRTKPEQIQEYAEEALRLYDLPVDVSLGQAHVRVRNLPESEDIRDLRHEHHGNLVAVRGIIRKATDVRPKVIEAAFECQRCGTLTRIPQTAGDFQEPHDCQGCERQGPFRLNTDQSQFIDAQKLRVQESPEGLRGGETPQSIDINIEDDITGHVTAGDHVRVTGILKLDQRGNDNEKSPMFDIYMEGVSVEIEDEQFEDMEITDADKTEIVELSSEPDIYDKMVGAIAPSIYGYEKEKLAMMLQLFSGVTKELPDGSRIRGDLHMLLIGDPGTGK

SEQ ID NO: 722 - protein, 965 aa, Haloarcula marismortui ATCC 43049
  Hma Pol-II N-extein
MREADEQYFETLETQLEAAFDVAERAKERGGDPKPEVEIPTARDMADRVENILGIDGVAERVRELEGQMSREEAALELVEDFVEGTVGDYDSREGKVEGAVRTAVALLTEGVVAAPIEGIDRVELLENDDGTEFINVYYAGPIRSAGGTAQALSVLVADYARALLGIDQYKAREEEIGRYAEEIDLYDKDTGLQYSPKEKETKFIAEHMPIMLDGEATGDEEVSGYRDLERVDSNSPRGGMCLVLAEGIALKAPKIQRYTRNLDEVDWPWLQDLIDGTIGKDEADEGDSAEDANGDDAGEGADDDGGDEADEQAGPPRVEPADKYLRDLIAGRPVFSHPSKSGGFRLRYGRSRNHGFATAGVHPATMHLVDDFLATGTQIKTERPGKAAGVVPVDTIEGPTVRLANGDVRRIDDAEEALAVRNGVEKILDLGEYLVNYGEFVENNHPLAPASYTVEWWEQDLAAAGADVQAMQDSPHIDLADPSAEEAIEWATEYDAPLHPKYTYLWHDVSIEQVCALADAVEDAQVAQADGAYADPEMDGTAGDAHSDDGALVLPRSDAVQQTLEHLLIGHTQDEETITVTDWVPLVRTLGFSRSLERDWTREDLSEHARTYGESESLDAIGVAEDAEREDGQNAIKAINEVAPFQVRERAPTRIGNRMGRPEKSERRDLSPAVHTLSPIGEAGGAQRDVAKATKHADDMSDTPGQVEVEVARRRCPDCGTETHQANCAECSGTTEPVYVCPDCEAEVERDESGRAECGRCETLASPTQYKVLDLQEAYRDALQNVGERETAFEQLKAVKGLTSEEKVPEPMEKGILRAKHDVSAFKDGTVRYDMTDLPVTAVRASELDVSAERLRGLGYTEDIHGDPLTHEDQLVELKVQDIVLSDGAAEHMLQTARFVDDLLEQYYGLERFYEFDDREDLVGELVFGMAPHTSAATVGRVVGFTSAAVGYAHPYFHAAKRRN

SEQ ID NO: 723 - protein, 630 aa, Haloarcula marismortui ATCC 43049
  Hma PolB N-extein
MRGATLAVKLGYVTRWHILSACGNTPSTAGVFMRHLETRPRMSDGTQGTLGDFGQDADAGTDDRPVADEAAAIAGNGGSDDGDTSVVDLDERQFPPVEETVEFVVTQVDYTIEGQGDDESPVVHVFGRTDDNESVHARVFDFQPYFYAPTDSVTEDGLRQYDSIAGWEEADADGDPYESIRGERLTKIFGQTPRDVGQIRDDFDHYEADILFPNRLLIDKDITSGVRVPARELDDGSLKVHHEEITPVEAHADPRVNTFDIEVDDRQGFPEDGEEPIICLTSHDSYRDEYVVWLYESPDGIDGPEALAGYDPIREDFEADVRVFDEEEAMLEAFVDYIVDTDPDVLTGWNFDDFDAPYFLDRLEELQSYNHDFDLQIDRLSRVDEVWRSGWGGPDIKGRVVFDLLYAYKRTQFTELESYRLDAVGEQELGVGKERYTGDIGDLWEQDPEQLLEYNLRDVELCVELDREQDIIDFWDEVRTFVGCKLEDATTPGDAVDMYVLHKLHGEFALPSKGQQESEDYEGGAVFDPITGVRENVTVLDLKSLYPMCMVTTNASPETKVDPETYDGDTYRAPNGTHFRKEPDGVIREMVDELLSEREEKKAERNSFDPDNPEYERFDRQQAAVKVIMN

SEQ ID NO: 724 - protein, 492 aa, Haloarcula marismortui ATCC 43049
  Hma TopA N-extein
MRLIITEKDNAARRIAEILSEGGASANRRNGVNVYRWGNTRVVGLSGHVVGVDFPEEYNDWRDVEPVELIDADVTKEPTQENIVTTLKQLAREADEATIATDYDREGELIGKEAYELIREETDAPVDRVRFSSITEREVRDAFANPDDIDFDLAAAGEARQIIDLVWGAALTRFLSLSARQLGDDFISVGRVQSPTLKLIVDREREIQAFDPEDYWEIFADLQKNGSGFEAQYFYDDDGKEAERVWVEDDADDAYADLTNVDAATVTSVRRRTRTDSPPTPFNTTAFISAASSLGYSAQQAMSIAEELYTTGYITYPRTDNTVYPDDLEEDALLDEFVGAGHFGEDAEALLEQDDITATEGDEETTDHPPIHPTGEIPPKADLSDDEWEIYELVVRRFFATVAEAATWEHLRVVADAGGRSLKANGKRLVEPGYHEVYPYSSASENHVPDVEEGEELAISEVRMEAKQTQPPRRYGQSRLIQTMEDKGLGTK

SEQ ID NO: 725 - protein, 282 aa, Halobacterium salinarum NRC-1
  Hsa-NRC1 CDC21 N-extein
MDPDLADDYISHPDQLQEAAEEALRVYDLPVDVSLGQAHVRVHGLAEHTDIRAIRAEHLNTMVSIQGMVRKATDVMPKIQRAVFVCQRCGTDTEVPQGDAGFQEPYQCESCERQGPFKLDPDRSEFVDSQKLRIQESPEGLGGGETPQSIDVHVEDDATGNVTPGDHVTVTGVLRLDQSEEATDSPVFEHYMEGSSVVIEDAEFDELNISEADKEEIVALSDHEEIHEEMVDSMAPAIYGHREAKLAMMLQLFSGVTKHLPDKSRIRGDLHMLLIGDPGTGK

SEQ ID NO: 726 - protein, 925 aa, Halobacterium salinarum NRC-1
  Hsa-NRC1 Pol-II N-extein
MRPTDETYFETLETGLDDAFEVAEAARERGEDPTPNVEIPVAKDMADRVENILGIDGVAERVRDLDGEMSREEAALELVADFVDGRVGDYDTDAGKIEGAVRTAVALLTEGVVAAPIEGIDRVEVNDNDDGTQYVAVYYAGPIRSAGGTAQALSVLVADYARAMLGIDAFKPRDDEIERYAEEVDLYDSETGLQYSPKDAETTFITEHCPVMLDGEATGNEEVDGFRDLERIDTNSPRGGMCLVLAEGIALKAPKIQRYTRNLDEVAWPWLQDLIDGTIGADDADEDTPDAGSDSDATDEGDAPSASTDAEEPPRAAPSDKFLRDLIAGRPVFGHPSKNGGFRLRYGRARNHGNATAGVHPATMHLLDDFLATGTQIKTERPGKAAGIVPVDSIEGPTVKLANGDVRHINDPADALDVRNGVAEILDVGEYLVNYGEFVENNHELAPASYAPEWWIQDLDAAGADVQALRDSPYVDLTAPTADQAMAWATDYDAPLHPAYTYLWHDIDVEQFRALADAVADAHTDASDDDDRGVLVLDHTTTVRETLEALLVTHHQGDDTIRVDDWLPLARSLGVTESLDREWETLSEAAAEWPNAVRAVNEVAPFSVQERAPTRIGNRMGRPEKSESRDLSPAVHTLFPIGDAGGSQRDVADAARYAPDMSDTPGEIPVRVGDRVCPSCDEHTYESRCPDCGDWTDPHYECRDCGAVATPDESGRVECPNCGRDLDNVTTQVIDINDEYHGALRAVGERENAFDQLKGVKGLLSAEKTPEPMAKGVLRAKHDVTAFKDGTVRYDMTDLPVTAVTPAELDVTAGQFRELGYNQDIHGDPLEHDDQLVELRVQDVVLSDGAADHMLKTADFVDDLLTQYYGLDAFYDLDDRDDLVGELVFGMAPHTSAAVVGRVAGFTSASVGYAHPYFHAAKRRN

SEQ ID NO: 727 - protein, 655 aa, Haloferax volcanii DS70
  Hvo PolB N-extein
MTYIDKCLSVVPGAVRGNAGVFSRAAEAIAMTQTGLTDFGGNDTDGAGDARPDEEAAIVAGDAGQHVSDVVDTDEVRFPDPDGTVELAVTQVDYTIEGAGRDEYPVIHIFGRTADDETEHVRVLGFRPYFYAPTDSLDDGDLDKDVITGTEDGYESIRGEELTKIFGRTPRDQGQIRDEFDHYEADILFPNRLLIDKDIKGGVSVPERRLDDGTIQIPHQEVAPAEVDANLRVNTFDIEVNDRNGFPEEGEEPIICLTSHDSYRDEYVVWHAVADEGLGKRPDTLPNYDFLGEDGDVEVRTFDEEAAMLDAFLTYIEETDPDILTGWNFEDFDAPYFLDRLEEVDERTDLNLDYNRISRLGEVWRGGWGGPDIKGRVVFDLLYAYKRTQFTELESYRLDAVGELELDAGKERYSGDIGDLWEEDPERLLEYNLRDVELCVEIDRKQDIIAFWDEVRTFVGCKLEDAPTPGDTVDIYVLHKVHGEFALPSKGKQESEDYEGGAVFDPITGVKENVTVLDLKSLYPMCMVTINASPETKVDPERYDGEMFRAPNGTHFQQEPDGMIREMVDELLTEREEKKSLRNSHDPGSSEYEQFDRQQAAVKVIMNSLYGVLGWDRFRLYDKEMGAAVTATGRKVIEFTEQAANQIGYDVAYGD

SEQ ID NO: 728 - protein, 433 aa, Haloquadratum walsbyi DSM 16790
  Hwa GyrB N-extein
MSHETEYGAGDIQVLEGLEAVRKRPAMYIGSTDSRGLHHLVYEVVDNAIDEALAGHCDQIDVTLHEDGSVSVADNGRGIPVDTHEQHDIPAVEVIMTVLHAGGKFDNKSYQVSGGLHGVGVSVVNALSRWLEVEIKRDGALWRDRFEYGEPQPGAFERVRDLDPDEETGTTIRFWPSDDIFETTEFEFSTLENRLRELAFLNSGVEICINGETDDINSKFCFNGGIREFVKYLDETKTVLHDSVVHYQNEQDGIEVEVALQATEELQGSIHAFANNINTREGGTHLTGFKTALTRVINDYGREHNLLDGFDSLQGEDVREGLTAVVSIKHPDPQFEGQTKTKLGNSDVRGIVESTTHERLGTYLEENPDVAKVIVRKAVEAAKARKAAKQAEELTRRKSALESTSLPGKLADCQSRDPAESELFIVEGDSAGG

SEQ ID NO: 729 - protein, 571 aa, Haloquadratum walsbyi DSM 16790
  Hwa MCM-2 N-extein
MAQAPQDPQDLTDRFIQFYRKYYRDDIGTLAQQFPHEKRSLYIDYHDLYAFDVELAEDYRREPDQLREYAEEALRLYDLPADVKLGRAHVRMRSLPDTVDIRNIRVHDDHIGHLIAVQGIVRKATDVRPKITEAAFECQRCGTMTYIPQSDSGFQEPHECQGCERQGPFDVDFDQSEFIDAQKVRVQESPEGLRGGETPQSIDVDLEDDATGAVTAGDHVTTTGVLHIEQQTSGNEKTPIFDIYMDGRSVEIEDEEFDDMDITDEDVAEIVELSNDPDIYEKMVESVAPSIYGYDEEKLAMILQLFSGVTKHLPDGSRIRGDLHMLLIGDPGTGKCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHNSAMLQYIRNIAPRSVYTSGKGSSSAGL

SEQ ID NO: 730 - protein, 1131 aa, Haloquadratum walsbyi DSM 16790
  Hwa MCM-3 N-extein
MAQAPQDPQDLTDRFIQFYRKYYRDDIGTLAQQFPHEKRSLYIDYHDLYAFDVELAEDYRREPDQLREYAEEALRLYDLPADVKLGRAHVRMRSLPDTVDIRNIRVHDDHIGHLIAVQGIVRKATDVRPKITEAAFECQRCGTMTYIPQSDSGFQEPHECQGCERQGPFDVDFDQSEFIDAQKVRVQESPEGLRGGETPQSIDVDLEDDATGAVTAGDHVTTTGVLHIEQQTSGNEKTPIFDIYMDGRSVEIEDEEFDDMDITDEDVAEIVELSNDPDIYEKMVESVAPSIYGYDEEKLAMILQLFSGVTKHLPDGSRIRGDLHMLLIGDPGTGKCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHNSAMLQYIRNIAPRSVYTSGKGSSSAGLCVTGETRIHTTDGFVPLKQLATQHHPKKVTTETAAAYERELYTVDPTTQSAEVTQSKSSHVWRMPEKHCRRIRTASGKQLEASVNTPVLTVDDAEIKWKPISAIESNDSVVIPQYNNVERSSVSITDIFEFTQEQLKLTEKSITILRTEIVSQYQNIAAAADALNIDVNSVEALITGQPVVSDVIDRVCDAISVSSEDITIHHVIGPTGTAIELPEVLNDDLLYLLGAAFACGNIMTGETCEERWIQFHAPEESIRSHIIDAAVATFGSESIQTDTEQANTVQVISATVTRLFETLGLEQITDAAPREIHPRLTAVSGADAFIRGLFDTGGRIDNKNTPQIAIGTASEPLAEQIQLLLETYGIGSCRDTGDQSHTGTSTTQGQYLTLTGSDAQAYRTTIGTRTDSGSSWDRQVSSSHADSEPSVRSTTTDTRKRTDMHEHEIISAGDVSTVSSVESDGGTPQMPRSNIEPQSIGYDYESSRVNEIQTETVVEAVNTGKKEVFDLTVPNTQNFIGGGIVTHNTAAAVRDDFGDGQQWTLEAGALVLADKGIAAVDELDKMR

SEQ ID NO: 731 - protein, 1356 aa, Haloquadratum walsbyi DSM 16790
  Hwa MCM-4 N-extein
MAQAPQDPQDLTDRFIQFYRKYYRDDIGTLAQQFPHEKRSLYIDYHDLYAFDVELAEDYRREPDQLREYAEEALRLYDLPADVKLGRAHVRMRSLPDTVDIRNIRVHDDHIGHLIAVQGIVRKATDVRPKITEAAFECQRCGTMTYIPQSDSGFQEPHECQGCERQGPFDVDFDQSEFIDAQKVRVQESPEGLRGGETPQSIDVDLEDDATGAVTAGDHVTTTGVLHIEQQTSGNEKTPIFDIYMDGRSVEIEDEEFDDMDITDEDVAEIVELSNDPDIYEKMVESVAPSIYGYDEEKLAMILQLFSGVTKHLPDGSRIRGDLHMLLIGDPGTGKCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHNSAMLQYIRNIAPRSVYTSGKGSSSAGLCVTGETRIHTTDGFVPLKQLATQHHPKKVTTETAAAYERELYTVDPTTQSAEVTQSKSSHVWRMPEKHCRRIRTASGKQLEASVNTPVLTVDDAEIKWKPISAIESNDSVVIPQYNNVERSSVSITDIFEFTQEQLKLTEKSITILRTEIVSQYQNIAAAADALNIDVNSVEALITGQPVVSDVIDRVCDAISVSSEDITIHHVIGPTGTAIELPEVLNDDLLYLLGAAFACGNIMTGETCEERWIQFHAPEESIRSHIIDAAVATFGSESIQTDTEQANTVQVISATVTRLFETLGLEQITDAAPREIHPRLTAVSGADAFIRGLFDTGGRIDNKNTPQIAIGTASEPLAEQIQLLLETYGIGSCRDTGDQSHTGTSTTQGQYLTLTGSDAQAYRTTIGTRTDSGSSWDRQVSSSHADSEPSVRSTTTDTRKRTDMHEHEIISAGDVSTVSSVESDGGTPQMPRSNIEPQSIGYDYESSRVNEIQTETVVEAVNTGKKEVFDLTVPNTQNFIGGGIVTHNTAAAVRDDFGDGQQWTLEAGALVLADKGIAAVDELDKMRCVTGETLVSLADGRHVPIASLATDASKTGTIESKPDGVGRTIRGIDDLTVWTMTENKQLTGRPVTAIHQYDSPDTLWQITLSDGSEVTTTADHPFIIINRDGVHECPAKHLSENDEVYTPADGYTASTSDITPDSETSSDSLPDGGITQTRTNQYSSHRCDADLSDDELLDITTKTIKSIETVHPSDGTDVYDLTVSGTHNFVANGMIVHNSEDRSAMHEALEQQ

SEQ ID NO: 732 - protein, 335 aa, Haloquadratum walsbyi DSM 16790
  Hwa MCM-1 N-extein
MAQAPQDPQDLTDRFIQFYRKYYRDDIGTLAQQFPHEKRSLYIDYHDLYAFDVELAEDYRREPDQLREYAEEALRLYDLPADVKLGRAHVRMRSLPDTVDIRNIRVHDDHIGHLIAVQGIVRKATDVRPKITEAAFECQRCGTMTYIPQSDSGFQEPHECQGCERQGPFDVDFDQSEFIDAQKVRVQESPEGLRGGETPQSIDVDLEDDATGAVTAGDHVTTTGVLHIEQQTSGNEKTPIFDIYMDGRSVEIEDEEFDDMDITDEDVAEIVELSNDPDIYEKMVESVAPSIYGYDEEKLAMILQLFSGVTKHLPDGSRIRGDLHMLLIGDPGTGK

SEQ ID NO: 733 - protein, 966 aa, Haloquadratum walsbyi DSM 16790
  Hwa Pol-II-1 N-extein
MRDADKQYFETLESHLEQAFARARQAKGQGYDPKPEVEIPVARDMADRVENILAIPDVAERIRELDDERSREEVALELVTDFVEGTVGDYDTREGKIEGAVRTAVALLTEGVVAAPIEGIDRVEILSDDDGSEFVNVYYAGPIRSAGGTAQALSVLVADYARSLLDIDEYSARTDETERYAEEVSLYDRETGLQYSPKDKETKFITKHMPIMLDGEATGNEEVSGYRDLERVDTNAARGGMCLVLAEGIALKAPKIQRYTRQLAEVEWPWLQDLIDDTIGSDEHSNNSVKNGEADIVKTDKDTNESETEDGIDNDDYNDSGLEPANSPRADATNKYLRDLIAGRPVFGHPSAAGAFRLRYGRARNHGFATAGVHPATMHIVDDFIATGTQLKTERPGKAGGVVPVDSIKGPTVRLANGDVRCINDPEEAEKLQNGVEKILDLGEYLVNFGEFIENNHPLAPAAYVFEWWIQEFEASNADVQALRDDPTVDLESPTFENAMRWAKKHDIPLHPAYTYLWHDISVTEFDHLADAVAAGEITMNEVSDTNSASGNTSLRANTNTDDTLTIDTTPAIRETMERLLIEHHQDSDSIHIPAWRALALSLGIKIESDNDTGIGDRMWSLTDLSKHARKQDDGKSAIAAVNEVAPFQVRERAPTRIGSRMGRPEKSEDRDLSPAVHTLFPIGEAGGNQRNLSDAAQSFGDNTERGQISVQLGKRRCPYCETVGFELQCAECGRHTEPQFVCRECESVLSPDESGRVHCDRCERDVTSAEWQDIDLHQRYRDALDRVDERESSFEILKGVKGLTSSNKTPEPLEKGILRAKHGVSSFKDGTVRYDMTDLPVTAVRPKELDVTAAHFRELGYQTDINGNPLQFDDQLVELKVQDIVLPDGAAEHMMKTADFVDDLLEQFYELNQFYQIDERDDLIGELVFGMAPHTSAAVVGRIVGFTSAAVGYAHPYFHAAKRRN

SEQ ID NO: 734 - protein, 1524 aa, Haloquadratum walsbyi DSM 16790
  Hwa Pol-II-2 N-extein
MRDADKQYFETLESHLEQAFARARQAKGQGYDPKPEVEIPVARDMADRVENILAIPDVAERIRELDDERSREEVALELVTDFVEGTVGDYDTREGKIEGAVRTAVALLTEGVVAAPIEGIDRVEILSDDDGSEFVNVYYAGPIRSAGGTAQALSVLVADYARSLLDIDEYSARTDETERYAEEVSLYDRETGLQYSPKDKETKFITKHMPIMLDGEATGNEEVSGYRDLERVDTNAARGGMCLVLAEGIALKAPKIQRYTRQLAEVEWPWLQDLIDDTIGSDEHSNNSVKNGEADIVKTDKDTNESETEDGIDNDDYNDSGLEPANSPRADATNKYLRDLIAGRPVFGHPSAAGAFRLRYGRARNHGFATAGVHPATMHIVDDFIATGTQLKTERPGKAGGVVPVDSIKGPTVRLANGDVRCINDPEEAEKLQNGVEKILDLGEYLVNFGEFIENNHPLAPAAYVFEWWIQEFEASNADVQALRDDPTVDLESPTFENAMRWAKKHDIPLHPAYTYLWHDISVTEFDHLADAVAAGEITMNEVSDTNSASGNTSLRANTNTDDTLTIDTTPAIRETMERLLIEHHQDSDSIHIPAWRALALSLGIKIESDNDTGIGDRMWSLTDLSKHARKQDDGKSAIAAVNEVAPFQVRERAPTRIGSRMGRPEKSEDRDLSPAVHTLFPIGEAGGNQRNLSDAAQSFGDNTERGQISVQLGKRRCPYCETVGFELQCAECGRHTEPQFVCRECESVLSPDESGRVHCDRCERDVTSAEWQDIDLHQRYRDALDRVDERESSFEILKGVKGLTSSNKTPEPLEKGILRAKHGVSSFKDGTVRYDMTDLPVTAVRPKELDVTAAHFRELGYQTDINGNPLQFDDQLVELKVQDIVLPDGAAEHMMKTADFVDDLLEQFYELNQFYQIDERDDLIGELVFGMAPHTSAAVVGRIVGFTSAAVGYAHPYFHAAKRRNCFHPETKIWFRDTDNEWHHETIQTFVEDRLDDPEIDAVGTLVQEVDDNTDREISVPSIDDNGNERLQSVTAVSKHRAPNHLVQIETISGREITITPDHEMHIFEQGNLVSKQASKITSGEYAVIPKRLQTISPSSHTPQHDLLREFLTRDELTADRLIIHTSDPVRLCNRVFPEEVTSCKDAVEIMQNTACHLDKNKETLIGWLGEGRIPVALLRGFVETDEALLMSIPDDVQIGLRGEKVRIDRHIGFTEELTSLLGYYAAAGIVHTQTNPISYESAQQEQSRITFYNIDTQTQTDLLNALNSVFEIEPIQYNLDGEILGVPGELIRRVFDTVFDVGTQPSHKRIPQALFDASESHITSYLRCFFSTHDSLTTDTRDISATTVSREFKEDIIAALRRLGITAEVTTQQSRSVPEVLPDWYAIDDITHHDADNSLNLTRSYVISIASSDAVTLQRDRQAQEQIKYDAQGLIANNNAIHQSRQVTDGGRKDYITEPITDIEYVDADIDYTYCLTVSETHSLIVNDLSQKQCDGDEDCVMLLMDGLLNFSREYLPDKRGG

SEQ ID NO: 735 - protein, 318 aa, Haloquadratum walsbyi DSM 16790
  Hwa PolB-1 N-extein
MPKFLANSAKTVDMKQAGLSDNWSDAADSGAGTSNARPDAEALAVAGKDTQHVSAIVDADEVRFPDADGSVELLVTQVNYSVERAGHEEYPVVHIFGRTADDTAHHVRVLGFEPYFYAPTESLNDDLLDNDAITRTESGYESIRGEELTKICTRTPRDVGQIRDDFDHYEADILFPNRLLIDKDIKSGIRVPARRLADKPQTIQIPHTEIEPVDVEANLRVNTFDIEVDDRSGFPEDGEEPIVCLTSHDSERDEYITWLYNAPNAAEDTDPPDSLDRDDSIRSDTTADVRTFNREDAMLDAFVSYIEQTDPDILTGWN

SEQ ID NO: 736 - protein, 1437 aa, Haloquadratum walsbyi DSM 16790
  Hwa PolB-3 N-extein
MPKFLANSAKTVDMKQAGLSDNWSDAADSGAGTSNARPDAEALAVAGKDTQHVSAIVDADEVRFPDADGSVELLVTQVNYSVERAGHEEYPVVHIFGRTADDTAHHVRVLGFEPYFYAPTESLNDDLLDNDAITRTESGYESIRGEELTKICTRTPRDVGQIRDDFDHYEADILFPNRLLIDKDIKSGIRVPARRLADKPQTIQIPHTEIEPVDVEANLRVNTFDIEVDDRSGFPEDGEEPIVCLTSHDSERDEYITWLYNAPNAAEDTDPPDSLDRDDSIRSDTTADVRTFNREDAMLDAFVSYIEQTDPDILTGWNCLPSDARIQMADGTETEIHAVEIGDNVIGTTDQRSVTATVTNKWKSEREIYEFSLADGTSLRSSGDHRIMISDSNTVDWKSGSDIEQGEYVLKPRQLPVDDPTIPIINNLLSSESANIIDTLEVDALDSTGRSMNIHSSNPRESIAHTATLSMADGGDQKQRNETTNNTLDLNRTVTKQDLYAIGRVLHNRITPRQDGITPVSQATLIDNSVLSSPSPANTQHQSDSILTEVISSLRGLVSPGAHAIDFSAIYEMPKSHIAQFLAGTLDGSETGETTSSNLTVTTESASIARWYAQLYRRLGIYAQYQADAVHIANNACDLQRLSDAILPRLRCSDTIDYVKTQIDTVCDSSLKHSRASSTGLSGDEANIRQFSDDGPQNKSYAAQPDSSDYDDDWNAYVFVEIEAITLNGTETTYDIETTTHNFVADDCLVHNCDDFDVPYFLDRMEVINPQSEYTLTSERFSRIDEVWRSGWGGPNIKGRVVFDLLYAYKRTQFTELESYRLDAVGELELDVGKERYPGDIGDLWEQDPQQLLEYNLRDVELCVEIDRKQDIIAFWDEVRSFVGCKLEDATTPGDTVDIYILHEAHDRFALPSKGRTDAEDYEGGAVFDPATGVKEMVGVLDLKSLYPMAMTTINASPETKVDPKNYDGDTFRAPNGTHFRRSPDGIIREMIDDLLAEREEKKSLRNEYDPGESVYEQYDRQQTAVKVIMNCFTPDTNVLTPNGVRNIRDLTVGDSVYSLNPETMQMEIKPVTQTHEYPDYQGDLIDIQTNEIDFRVTPNHRMLVEATGTDTTSTNDYDFIEAGNLDISSRYELPHGWSVDHTDSLGAYIDLITLLREQSDTYNVLSDGGMTTAATADINHNNVTRRVDSDTFVSLIGWYVATGRVSRTQNGSDRVYLQLSQTNTKARTQLTMLLDELGVDWQADNEKIHFVSHVWTELFDTTCGRTEKNKHIPELIFDASASQKRAFFDAIINGSGVKNDDSYQYHTSSEDLRDDILRLCVHIGIVARYDYINDESWRIECTETANPDFTLTHSGRQSTAEDGVYCVTVADNQTLLAGRNGTFQWTGNSLYGVLGWDRFRLYDKEMGAAVTATGRDVIEHTADAASDLDKSVIYGD

SEQ ID NO: 737 - protein, 201 aa, Haloquadratum walsbyi DSM 16790
  Hwa RIR1-1 N-extein
MDTHDVDADELELPIKRTTGETIEQRLTDNAYHNILPARYLRKDAKGDLAESQEEIFERVAQNVALAEAVFEADKQDTEITVTPDQLKPDHPRRDELAEEVFGAGADAADTVTTTLSVYNVNKFAYETIVPELPDEVQHHVKSVADEFEDLMSRLSFMPNSPTLMNAGDELQQLSACFVDSPSDDISDIHQTAKEAAEVFQ

SEQ ID NO: 738 - protein, 1036 aa, Haloquadratum walsbyi DSM 16790
  Hwa RIR1-2 N-extein
MDTHDVDADELELPIKRTTGETIEQRLTDNAYHNILPARYLRKDAKGDLAESQEEIFERVAQNVALAEAVFEADKQDTEITVTPDQLKPDHPRRDELAEEVFGAGADAADTVTTTLSVYNVNKFAYETIVPELPDEVQHHVKSVADEFEDLMSRLSFMPNSPTLMNAGDELQQLSACFVDSPSDDISDIHQTAKEAAEVFQCLTADSTVMLKEKGMVSVSEVETGDQIAQRSDTGFQYKPVEETHAYENAETLTVTLTNGCSIRGTPNHRLMVDDEWTRIDEIQPDQEVHYTLGWLRETNQSPPKLHSQSHTTVNQTADSISPDSSEPIELSESENADTGNRHNSAVAVKQSRTQTQLISDEVVSRPEHTRRPDQLSEELAELLGLWIDTGLWHQSGVQFNVERENIAEYIDQLSQQLFDTPAAISDTDGTYTVDITDHKLKEWWKANFGGKPDGTQSSYVPQMIKEAPTNVIEAFLRGCFTAEGGLRKDMRPRLCTSSEDSIDDIAVLMMGLGYPVEKSVIRNADGEPYYSVMPATDDGLSAFLHDVGFIDERREIGLSNIESSDSRALNNTHKIEVESIVESPPATVYDITVADNHEYVTDGIISHNSGGGMGYAFWKLRPYGDSVGSTGGIASGPITFMRTYDQMCETIAQGGARRGAQMGVMRISHPDVIQFIHAKNKDVSLAHSLRLNDPDDFTHTSFADALEEARELIDEEGRVPEHLRNAVEGHLSNFNISVGVTDEFMEALFADEEFTFTNPRTEDPHIATPETKELYELHDLGEHVEVGEELSVPAEELWDHIVSGAHENGEPGVIYLERVNKEHSFDVEKHSEHEILATNPCGEQPLEEYEACNLGHINLSTLADKDAPDWRVWYDNNGDAYNNLDDAAEAFIYEAIDMNAFNRRIESGTRFLENVVTMSDFPVDEIEATVRDMRKIGLGIMGLAQLYIQIGVRYGSQEANAIAEQLMTHINHESKWASHELAKERGTFNDWTESKYANPTEYREWFEHHTGLDASEWEDGFLIRNHNTTTIAPTG

SEQ ID NO: 739 - protein, 87 aa, Haloquadratum walsbyi DSM 16790
  Hwa rPol A'' N-extein
MTETITDASEYEHITDDIAAIVDDYNLPESLQHRIYETIEERGEVPIEKVDDIAQAIASRYEDSRVDAHDPVGTVSAQSIGEPGTQM

SEQ ID NO: 740 - protein, 116 aa, Haloquadratum walsbyi DSM 16790
  Hwa Top6B N-extein
MTSFQSTLGEEGEIADELAESQRAISIAEFFEKNKHMLGFDSGARGLVTAVKEAVDNALDATEEAGIKPDISIEIRESGDYYTLIVEDNGPGITREQVPKVFGKLLYGSRFHAREQ

SEQ ID NO: 741 - protein, 271 aa, Invertebrate iridescent virus 6; identical to SEQ ID NO: 694
  IIV6 RIR1 N-extein

SEQ ID NO: 742 - protein, 18 aa, Kazachstania exigua, formerly Saccharomyces exiguus, strain CBS379
  Kex-CBS379 VMA N-extein
ISQSLSKYSNSDAIIYVG

SEQ ID NO: 743 - protein, 276 aa, Kluyveromyces lactis IFO1267
  Kla-IFO1267 VMA N-extein
ARKELKRVTLEDHEESEYGAIYSVSGPVVIAENMIGCAMYELVKVGHDNLVGEVIRIDGEKATIQVYEETTGVTVGDPVLRTGKPLSVELGPGLMETIYDGIQRPLKAIKDISQSIYIPRGIDAPALSRTIKWQFTPGKFKVGDHISGGDIFGSIFENSLLDDHKILLPPRARGTVTWIASAGEYTVDEKILELEFDGVKYDYSMYHTWPVRVPRPVTEKLSADYPLLTGQRVLDSLFPCVQGGTTCIPGAFGCGKTVISQSLSKYSNSDAIIYVG

SEQ ID NO: 744 - protein, 283 aa, Kluyveromyces lactis NRRL Y-1140
  Kla-NRRLY1140 VMA N-extein
MAGALENARKELKRVTLEDHEESEYGAIYSVSGPVVIAENMIGCAMYELVKVGHDNLVGEVIRIDGEKATIQVYEETTGVTVGDPVLRTGKPLSVELGPGLMETIYDGIQRPLKAIKDISQSIYIPRGIDAPALSRTIKWQFTPGKFKVGDHISGGDIFGSIFENSLLDDHKILLPPRARGTVTWIASAGEYTVDEKILELEFDGVKYDYSMYHTWPVRVPRPVTEKLSADYPLLTGQRVLDSLFPCVQGGTTCIPGAFGCGKTVISQSLSKYSNSDAIIYVG

SEQ ID NO: 745 - protein, 416 aa, Kineococcus radiotolerans SRS30216
  Kra DnaB N-extein
MTAYDEPPADFDAPDDGPSRGRRGGRKDRGADGGGASFDRMPPQDIAAEQGVLGGMMLSKDAIADVVEVLKGNDFYRPAHELVYEAILDLYSRGEPADPVTVSAELTNKGELTRIGGTPYLHDLISTVPTAANAAFYARIVRERAVLRRLVEAGTRIVQMGYGADGMDVDAIVNSAQAEVYAVTETRTKEDYAVLGDVIEGTIDEIEASSHRGEGMVGVPTGFADLDSLTNGLHPGQMIVIAARPAVGKSTLGLDIARAASIKHGLASVIFSLEMGRNEIAMRLLSAEARVPLQKMRKGNMDDADWTRFARTMGAINEAPLYIDDSPNMSLMEIRSKCRRLKQRADLKLVIVDYLQLMTSGKRVESRQQEVSEFSRALKLLAKEIEVPVIALSQLNRGPEQRTDKRPMVSDLRESG

SEQ ID NO: 746 - protein, 34 aa, Listonella pelagia phage phiHSIC
  LP-phiHSIC helicase N-extein
MAFELRPYQKEAVKKVIEHVKICLDPCVVDAATG

SEQ ID NO: 747 - protein, 232 aa, Mycobacterium avium
  Mav DnaB N-extein
MAVVDDLTSGMDSSSPSEDFGRQPPQDLAAEQAVLGGMLLSKDAIADVLERLRPGDFYRPAHQNVYDAILDLYGRGEPADAVTVAAELDRRNLLRRIGGAPYLHTLISTVPTAANAGYYATIVAEKALLRRLVEAGTRVVQYGYAGAEGADVAEVVDRAQAEIYEVAERRTTEDFVPLEDLLQPTMDEIDAIASNGGVARGVPTGFTELDEVTNGLHAGQMIIVAARPGVGK

SEQ ID NO: 748 - protein, 232 aa, Mycobacterium avium 104; identical to SEQ ID NO: 747
  Mav-104 DnaB N-extein

SEQ ID NO: 749 - protein, 232 aa, Mycobacterium avium subsp. paratuberculosis str. k10; identical to SEQ ID NO: 747
  Mav-PT DnaB N-extein

SEQ ID NO: 750 - protein, 399 aa, Mycobacterium bovis subsp. bovis AF2122/97
  Mbo-AF2122 DnaB N-extein
MAVVDDLAPGMDSSPPSEDYGRQPPQDLAAEQSVLGGMLLSKDAIADVLERLRPGDFYRPAHQNVYDAILDLYGRGEPADAVTVAAELDRRGLLRRIGGAPYLHTLISTVPTAANAGYYASIVAEKALLRRLVEAGTRVVQYGYAGAEGADVAEVVDRAQAEIYDVADRRLSEDFVALEDLLQPTMDEIDAIASSGGLARGVATGFTELDEVTNGLHPGQMVIVAARPGVGKSTLGLDFMRSCSIRHRMASVIFSLEMSKSEIVMRLLSAEAKIKLSDMRSGRMSDDDWTRLARRMSEISEAPLFIDDSPNLTMMEIRAKARRLRQKANLKLIVVDYLQLMTSGKKYESRQVEVSEFSRHLKLLAKELEVPVVAISQLNRGPEQRTDKKPMLADLRESG

SEQ ID NO: 751 - protein, 252 aa, Mycobacterium bovis subsp. bovis AF2122/97
  Mbo Pps1 N-extein
MTLTPEASKSVAQPPTQAPLTQEEAIASLGRYGYGWADSDVAGANAQRGLSEAVVRDISAKKNEPDWMLQSRLKALRIFDRKPIPKWGSNLDGIDFDNIKYFVRSTEKQAASWDDLPEDIRNTYDRLGIPEAEKQRLVAGVAAQYESEVVYHQIREDLEAQGVIFLDTDTGLREHPDIFKEYFGTVIPAGDNKFSALNTAVWSGGSFIYVPPGVHVDIPLQAYFRINTENMGQFERTLIIADEGSYVHYVEG

SEQ ID NO: 752 - protein, 251 aa, Mycobacterium bovis subsp. bovis AF2122/97
  Mbo RecA N-extein
MTQTPDREKALELAVAQIEKSYGKGSVMRLGDEARQPISVIPTGSIALDVALGIGGLPRGRVIEIYGPESSGKTTVALHAVANAQAAGGVAAFIDAEHALDPDYAKKLGVDTDSLLVSQPDTGEQALEIADMLIRSGALDIVVIDSVAALVPRAELEGEMGDSHVGLQARLMSQALRKMTGALNNSGTTAIFINQLRDKIGVMFGSPETTTGGKALKFYASVRMDVRRVETLKDGTNAVGNRTRVKVVKNK

SEQ ID NO: 753 - protein, 183 aa, Methylococcus capsulatus Bath, prophage MuMc02
  Mca MupF N-extein
MTLPAADLKAIFNLEPKAAIAYLQHKGYKLTWNWQEMLDDAHARAFTIAKAARLDVVQDIRNALDVALRHGQTLKDFQKNLKPTLQAKGWWGKQIIVDGAGNAEVARLGSPWRLATIYRTNLQSAFMAANYQEMAEATDSHPYWQYVAVLDGRTRPSHRAMNGRVFRHDDPIWNTIWPPNGFN

SEQ ID NO: 754 - protein, 282 aa, Methylococcus capsulatus Bath
  Mca RIR1 N-extein
MEPQAISLEVLREKYARHGETCAEEIFARVADALAAAEESPDEWRPLFFSALESGFIPAGRIMSAAGTGMQATLINCFVQPVGDSVSEETDGKPGIYTALAEAAETMRRGGGVGYDFSAIRPRGARVHTTESRASGPVSYMRVFDRSCETVESAGSRRGAQMGILRCEHPDIFEFVRAKDRPGELTNFNLSVALNEDFMRAVETDGPWELTHRAEPSPEQQCEGAYLREDGLWVYRSVPARELWELIMRSTYDHAEPGVLFIDRMNRENNLSYCERIEATNP

SEQ ID NO: 755 - protein, 9 aa, Mycobacterium chitae
  Mch RecA N-extein
REKIGVMFG

SEQ ID NO: 756 - protein, 414 aa, Methanoculleus marisnigri JR1
  Memar MCM2 N-extein
MTEEITVEVTDNVGEWTKFLKKQYKRELAELSREYPHNHSLLIDYRKILNNKLAFELLRSPGKVLGDIRDAIVQNKLLKLKDGQDPDLVNIRFTNLPQKTNVRDIRADQINTFVSLEGILRKTTEVRPRIVSAVFRCRTCNKNTDPVPQGYGRFDEPDFCPNCERKTRLDLVMNRCRFVDAQKLRIQESPEGLRGGEQPQTLDIDVTDDLTGMVSPGDRVVVNGILRSVQRVNYGQKSTLFDIYLECNSIEVAEKEFEEVSISEEDEANIMALARDPMVYKKIARSIAPTIYGTDDVKEAIALQLFGGIAKDMPDGSRLRGDVHVLLVGDPGIAKSQILRYVVKLSPRGIYTSGKSSTSAGLTATAVKDEFGDGRWTLEAGALVLADMGIAAVDEMDKMQKEDRSALHEAMEQQ

SEQ ID NO: 757 - protein, 870 aa, Methanoculleus marisnigri JR1
  Memar Pol-II N-extein
MEVSPAIARYFEELEGELDAAIRLAAAARARGLDPRTEIEIPVASDLADRVEALLGYKGIAARIRELEAEMSREEAALRIGDDFAARKFGETTPEEILDHAIRAAMALLTEGVVAAPTEGIGKVSLGKNDDGTDYLKIYYAGPIRSAGGTAQALSVLVGDYVRQALGINRYIPRPEEVERYIEEIRQYNNIMSLQYLPSEKELRMIIENCPVCIDGEPTEQQEVSGYRNLERVETNTVRGGMALVVAEGLALKAPKVLKNVRKMKMEGWDWIEEMIGGGPKSDDDDASAAIKPKDKYIRDLIGGRPVFSYPMRKGGFRLRLGRARNTGFAAAGFNPATLHILGDFLAVGTQMKVERPGKAAGVVPVDSIQGPTVKLRSGEVRRVDDAAEARRLAGQVDEILDVGEMLVSFGEFMENNHPLMPPAYCEEWWMLEGGPRHPENELEAIEFALDGVPLHPDYTYMWDDVAPADIARLAEAVGTGGTVEDGVLMIRNTPETKAILEELLIPHHLSGDRLAIREHLAFLACLGLTLQLTKRPAWQDAPMENSLDLVMHLSGFTVRSRAGTRIGGRMGRPGKSKPREMRPPPHSLFPIGDEGGARRSFQAACSSKPRSNTDGGVIEAEVGERQCPACGAFTYKNLCECGAHTNPVFRCPRCGKDVGQDVCPRCNAETVCLQKVTINVKAEYLAAMESLGVRESSVALLKGVKGLISRERPVEPIEKGILRALQNLYVFKDGTVRYDMIDLPLTHFRPDEVGVPIERLRELGYTHDTYGRELVSDDQVLELRHQDILVSEGCGEWLVRVAKFVDDLLVRLYGLEPFYKAEKPLDLVGHLLMGLAPHTSAGVLVRLIGFSKAPVGYGHPFFHAAKRRN

SEQ ID NO: 758 - protein, 9 aa, Mycobacterium fallax
  Mfa RecA N-extein
REKIGVMFG

SEQ ID NO: 759 - protein, 69 aa, Mycobacterium flavescens Fla0
  Mfl GyrA N-extein
RGIFRPDRSHAKSARSVAETMGNYHPHGDASIYDTLVRMAQPWSLRYPLVDGQGNFGSPGNDPPAAMRY

SEQ ID NO: 760 - protein, 9 aa, Mycobacterium flavescens, ATCC14474
  Mfl-ATCC14474 RecA N-extein
REKIGVMFG

SEQ ID NO: 761 - protein, 63 aa, Mycobacterium gastri
  Mga GyrA N-extein
DRSHAKSARSVAETMGNYHPHGDASIYDTLVRMAQPWSLRYPLVDGQGNFGSPGNDPPAAMRY

SEQ ID NO: 762 - protein, 9 aa, Mycobacterium gastri
  Mga RecA N-extein
RDKIGVMFG

SEQ ID NO: 763 - protein, 15 aa, Mycobacterium gastri
  Mga SufB (Mga Pps1) N-extein
AEKQRLVAGVAAQYE

SEQ ID NO: 764 - protein, 872 aa, Methanospirillum hungateii JF-1
  Mhu Pol-II N-extein
MADISPRMQEYYDRLNAGLAQAMEVAKTARKTGLDPETVVEIPIANDLADRVEAQVGIPGVAQMIRELEAVMSREEASLHIGDYFAEKKFGETTKEEILDHAIRTAMALLTEGVVSAPIEGIAKVAVKKNDDGSEYLAIYYAGPIRSAGGTAQALSVLVGDYVRRILGMSRYMPREEEIERYIEEIRQYNSIMSLQYLPSEREIRLIISNCPVCIDGEPTEKEEVSGHRNLERVETNTVRGGMALVIAEGLALKAPKVLKNVRKMKMDGWDWLEEMIQATAGSSSSEEKEVGIHPKDKFLRDLIGGRPVFSYPMREGGFRLVYGRSRNTGLAAAGLNPATLHILGDFLAVGTQMKIERPGKAAGISPVDSIQGPTVRLINGDVVRIHDAKRARELSSQVSHIIDVGEILISYGEFMENNHVLVPSAYCESWWRLEGGTTRPADEDEAILQCESGLYLHPDYLYLWDDLKPAEIRSLAEFIHKHGTLADKTLILPLDPTIKEYLERVLCEHQVREGMIRITPCRIVLKCLGLDSSLALSDSWEKELPESALDLVQFLSGMKMRSKAGTRIGGRMGRPGKSKPREMKPAPHVLFPVGEAGGSRRSVQEASKFSYQANTEGGNLQLEMGVRRCPACGTESYKNRCSCGTHTEPVLSCSRCGIEVQGPVCPQCGMEPTSVRQYTVNVRQMLQQAFADLGMRDRDVELVKGVKGLVSRNKPVELIEKGVIRAANKLFVFKDGTVRFDIIDMPLTHFRPREIGVSVERLRELGYLQDIYGVPLQNPDQVLELPPQDILVPEGCGDYLFSCTRFIDTLLEKVYGLPPFYNLETRSDLVGHLVIGLAPHTSAGVLARIIGFSKANVGYGHPFFHAAKRRN

SEQ ID NO: 765 - protein, 74 aa, Methanococcus jannaschii (Methanocaldococcus jannaschii DSM 2661)
  Mja GF-6P N-extein
MKFMCGIIGYIGNDKAPKILLNGLRRLEYRGYDSCGIGVVDNNKLIIKKNVGKVEEVAKKERFLDIDGNIGIGH

SEQ ID NO: 766 - protein, 337 aa, Methanococcus jannaschii (Methanocaldococcus jannaschii DSM 2661)
  Mja Helicase N-extein
MDKILEILKDFGIVELRPPQKKALERGLLDKNKNFLISIPTASGKTLIGEMALINHLLDGNKNPTNKKGIFIVPLKALASEKYEEFKSKYERYGLRIALSIGDYDEDEDLSKYHLIITTAEKLDSLWRHKIDWINDVSVVVVDEIHLINDETRGGTLEILLTKLKEFNVQIIGLSATIGNPDELAEWLNAELIVDDWRPVELKKGIYKNEAIEFINGEIREIKAVDNNDIYNLVVDCVKEGGCCLVFCNTKRNAVNEAKKLNLKKFLTEEEKIRLKEIAEEILSILEPPTEMCKTLAECILNGSAFHHAGLTYQHRKIVEDAFRKRLIKVICCTPTL

SEQ ID NO: 767 - protein, 128 aa, Methanococcus jannaschii (Methanocaldococcus jannaschii DSM 2661)
  Mja Hyp-1 N-extein
MIANVDLHIHSRFSGGTSKDMNVENILKYGKLKGLNIIGTGDCTHPDYLEEIKQYKDRELILTTEIEDKNRVHHLILLPSISKVEELREILKKYSKDIDKEGRPRVSIGGAELLEIVRDVGGLIGPAH

SEQ ID NO: 768 - protein, 30 aa, Methanococcus jannaschii (Methanocaldococcus jannaschii DSM 2661)
  Mja IF2 N-extein
MAKKNTKKDNKNQNLRCPIVCVLGHVDHGK

SEQ ID NO: 769 - protein, 404 aa, Methanococcus jannaschii (Methanocaldococcus jannaschii DSM 2661)
  Mja Klba N-extein
MIIKNQLIFVNFYVILIIWWFVMGILDKIQKKSEKIEKEKKSETVIPSDTKLKPIEPHPTINKKATVGNDETILDTYSIKIDEIEMEVVIKREEGYIYYLVPEIDKINMSLSKLTKDHLNHIKSQISDLGLIEYDQIREYLTNFSMRYNLAIPYIDSLAKFFYLVIGRLGLLEVPLNDDRLEEVMVNGYNVPVFVFHRKHQMCETNIVLDRNEVDRIIESIANLVNRPIDSRVPMLDAFLPDGSRVNATTADITMNGATLTIRKFSKNPLTVIDLINFGTLDIDTAAFLWQAVEGYFGAKPANTLIAGGTGSGKTTLLNVLSLFSMYNERIITIEDTPELQIPHKHVIKMVTRPARPGMPEYEVTMDDLIKNALRMRPDRIFVGEVRGKEAHSLLVAMNTGHDG

SEQ ID NO: 770 - protein, 410 aa, Methanococcus jannaschii (Methanocaldococcus jannaschii DSM 2661)
  Mja PEP N-extein
MLIIQNTKGDSMKFIAWLDELSNKDVDIAGGKGASLGEMWNAGLPVPPAFVVTADAYRHFIKETGLMDKIREILSGLDVNDTDALTNASKKIRKLIEEAEMPEDLRLAIIEAYNKLCEMCGEDEVTVAVRSSATAEDLPEASFAGQQDTYLNIKGAENVVKYVQKCFSSLFTPRAIFYREQQGFDHFKVALAAVVQKLVNAEKAGVMFTVNPISENYDELVIEAAWGLGEGVVSGSVSPDTYIVNKKTLEIVDKHIARKETMFVKDEKGETKVVEVPDDMKEKQVLSDDEIKELAKIGLNIEKHYGKPMDVEWAYEKGKFYMLQARPITTLKKGKKEKKAKEEDIEAKILLKGIGASPGIATGVVKIIHDVSEIDKVKEGDILVTEMTTPDMVPAMKKAAAIVTDEGGLT

SEQ ID NO: 771 - protein, 425 aa, Methanococcus jannaschii (Methanocaldococcus jannaschii DSM 2661)
  Mja Pol-1 N-extein
MGMSMGKIKIDALIDNTYKTIEDKAVIYLYLINSILKDRDFKPYFYVELHKEKVENEDIEKIKEFLLKNDLLKFVENIEVVKKIILRKEKEVIKIIATHPQKVPKLRKIKECEIVKEIYEHDIPFAKRYLIDNEIIPMTYWDFENKKPVSIEIPKLKSVAFDMEVYNRDTEPNPERDPILMASFWDENGGKVITYKEFNHPNIEVVKNEKELIKKIIETLKEYDVIYTYNGDNFDFPYLKARAKIYGIDINLGKDGEELKIKRGGMEYRSYIPGRVHIDLYPISRRLLKLTKYTLEDVVYNLFGIEKLKIPHTKIVDYWANNDKTLIEYSLQDAKYTYKIGKYFFPLEVMFSRIVNQTPFEITRMSSGQMVEYLLMKRAFKENMIVPNKPDEEEYRRRVLTTYEGGYVKEPEKGMFEDIISMDFR

SEQ ID NO: 772 - protein, 882 aa, Methanococcus jannaschii (Methanocaldococcus jannaschii DSM 2661)
  Mja Pol-2 N-extein
MGMSMGKIKIDALIDNTYKTIEDKAVIYLYLINSILKDRDFKPYFYVELHKEKVENEDIEKIKEFLLKNDLLKFVENIEVVKKIILRKEKEVIKIIATHPQKVPKLRKIKECEIVKEIYEHDIPFAKRYLIDNEIIPMTYWDFENKKPVSIEIPKLKSVAFDMEVYNRDTEPNPERDPILMASFWDENGGKVITYKEFNHPNIEVVKNEKELIKKIIETLKEYDVIYTYNGDNFDFPYLKARAKIYGIDINLGKDGEELKIKRGGMEYRSYIPGRVHIDLYPISRRLLKLTKYTLEDVVYNLFGIEKLKIPHTKIVDYWANNDKTLIEYSLQDAKYTYKIGKYFFPLEVMFSRIVNQTPFEITRMSSGQMVEYLLMKRAFKANMIVPNKPDEEEYRRRVLTTYEGGYVKEPEKGMFEDIISMDFRCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNSLYPSIIISYNISPDTLDCECCKDVSEKILGHWFCKKKEGLIPKTLRNLIERRINIKRRMKKMAEIGEINEEYNLLDYEQKSLKILAN

SEQ ID NO: 773 - protein, 866 aa, Methanococcus jannaschii (Methanocaldococcus jannaschii DSM 2661)
  Mja r-Gyr N-extein
MIPMIYKEMCPNCNGEITSERLAIGVCEKCLKEENVFEKLKLCEKLREEKTLKNLKDYCIIWNEFKEFEEFVKDLGFELLSIQKMWAKRVLKNKSFSIVVPTGVGKSFFGILMSLFLAKKGKRCYIILPTTLLVKQTYEKISSLTEKNNLNIRVVAYHSELSTKEKKEVKERIENNDYDVLITTSNYLTKNMPKCKFDFVFVDDVDALLKASKNIDRTLKLLGFDEEIINEAYKIIYLIKIGKIEDAMKKREILKKKISKIKHGCLIIASATGKSYGDRVKLYRELLDFEIGFGMNKLRDVVDIYDEEFSKEKILEYIKLFGSGGIVFVSIDYGVEKAQEIEKYLLENNIKAKLIHSKDKKGFDDFREGKIDVLIGVASYYGVLVRGLDMPERVRYAIFYGIPKFKIRLKEYINSLKEKGELKEDINIEGKTEEEIRQIITEKLKIKNFSLRKEDDEYLLLIPDVKTYIQASGRTSRMTEFGLTKGASIVLVDEKEIFEALKKYMLFMYESEFKRIDEVNLEELIKKIDEDREKIKVGRAKGKVPDLLKSVLMVVESPNKARTIANFFGKPSVRKINNRNVYEVCIGDLNLIITASGGHVFDLVTKEGFYGVKIENNLYIPIYTSIKKVNGEQFTDQKDLEELIKQLMEKGERVNAMDAKENIEIIREIADEVDAIFIATDIDTEGEKIGYDIAINALPFNRNIYRVGFNEITKRAILKAVESFKKGEELSLDENKVKGQVVRRIEDRWIGFRLSQKLWEVFNKNYLSAGRVQTPVLGWIIERYNEHKIKVPYLSLKLENDIYIGKIWEDEFDKDEVEVEVKVYEKEIPPLPPFTTDTLLEEATKRFGLSTDEIMSIAQELFELGL

SEQ ID NO: 774 - protein, 53 aa, Methanococcus jannaschii (Methanocaldococcus jannaschii DSM 2661)
  Mja RFC-1 N-extein
MVIIMEKPWVEKYRPKTLDDIVGQDEIVKRLKKYVEKKSMPHLLFSGPPGVGK

SEQ ID NO: 775 - protein, 626 aa, Methanococcus jannaschii (Methanocaldococcus jannaschii DSM 2661)
  Mja RFC-2 N-extein
MVIIMEKPWVEKYRPKTLDDIVGQDEIVKRLKKYVEKKSMPHLLFSGPPGVGKCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNTTAALCLARDLFGENWRDNFLELNA

SEQ ID NO: 776 - protein, 1124 aa, Methanococcus jannaschii (Methanocaldococcus jannaschii DSM 2661)
  Mja RFC-3 N-extein
MVIIMEKPWVEKYRPKTLDDIVGQDEIVKRLKKYVEKKSMPHLLFSGPPGVGKCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNTTAALCLARDLFGENWRDNFLELNASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSDERGIDVIRTKVKDFARTKPIGDVPFKIIFLDESDALTADAQNALRRTMEKYSDVCRFILS

SEQ ID NO: 777 - protein, 337 aa, Methanococcus jannaschii (Methanocaldococcus jannaschii DSM 2661)
  Mja RNR-1 N-extein
MISAKDFAEKVMEFYVIKRDKRKEKFNVNKLAKSLINSGVNYGDLDTIISEVCAKVYNGITTDELKDIVYNVLKKIDKDVAENYRNGIILKVRTSEKEFESFDKEKIAKALIRETGADEETARKIADEVERELKKLKVKYLTAPMIREIVNYKLIEYGFEELRHKHTRLGMPVYDITKLIKSGSRENANLMYNPESIHKWVADETMKQYALLAIFPKHIADAHIKGDIHLHDLEYAATRPVCLQHDLRPFFKYGLKVDGTGLHTSVSKPAKHPEVAIQHAAKVMMAAQTNMSGGQSIDEFNVWLAPYVRGLSYEKIKQLMQMFIYELNQMYVARGGQ

SEQ ID NO: 778 - protein, 1058 aa, Methanococcus jannaschii (Methanocaldococcus jannaschii DSM 2661)
  Mja RNR-2 N-extein
MISAKDFAEKVMEFYVIKRDKRKEKFNVNKLAKSLINSGVNYGDLDTIISEVCAKVYNGITTDELKDIVYNVLKKIDKDVAENYRNGIILKVRTSEKEFESFDKEKIAKALIRETGADEETARKIADEVERELKKLKVKYLTAPMIREIVNYKLIEYGFEELRHKHTRLGMPVYDITKLIKSGSRENANLMYNPESIHKWVADETMKQYALLAIFPKHIADAHIKGDIHLHDLEYAATRPVCLQHDLRPFFKYGLKVDGTGLHTSVSKPAKHPEVAIQHAAKVMMAAQTNMSGGQSIDEFNVWLAPYVRGLSYEKIKQLMQMFIYELNQMYVARGGQSLGRDELIFIKEGDKLKVCKIGEAIDEFMEKYKDKIIVDGDTEILYLDGIAEVYTISVNVKTGKAEFKRVYAISRHKPRGKVYKVIGKDGTSIIVTEDHSLFNYDENGNLVCVKPRQMKHIIRNFNNPYDVEYRIGDYIETNYQRTDSKYNSRQNDIPEKLKITKELCQFLGLFVAEGSYITNGISITTKDDDIAKFIERFVKEQINENIAVKRYEDSVRFVNKGFYRFLKEHINGKAINKNSPEFILKGDKEMKLAFLGGLISGDGYVSKDGRVQIYTTSEQLLGQLHLLLSDLGMIYSITKIKEEGEKIEIKRNEIVRNYKLYVIEIAKNCTEDLKPYVIPKYKKERIKPANYDQLPYDYRIIKEHLRKITDKKPYNDYAWKSNNRKLKLNTLEKIEQLNPHLREEINKFKLNIPFEIKEIKEIDYNGYVYDLSVEDNENFITATGILCHNTIFSSINLELEIPEFLKDKPAVIAGTTRGTYGDYEEEAKLILEALVDVMMEGDAMGKPFLFPNFIIKLRENAFKDENKELMYKIHQLSAKFGIPYFINMLPDWQVTNTNAMGCRTRLSGNWTGDAEIDTLRTGNMQWYSLNLPRIAYEANGDDTKLFEILHERLEILKEALLIKHEVTKERLYVDNLMPFLTQEFDGESYYRYENTTKTFGFVGLNEMLKYHLGEELHESKDAVKFGEKVIEYIREYADKLKEETGLRWTVTQTPAES

SEQ ID NO: 779 - protein, 463 aa, Methanococcus jannaschii (Methanocaldococcus jannaschii DSM 2661)
  Mja rPol A' N-extein
MVILMERYEIPKEIGEIMFGLLSPDYIRQMSVAKIVTPDTYDEDGYPIDGGLMDTRLGVIDPGLVCKTCGGRIGECPGHFGHIELAKPVIHIGFAKTIYKILKAVCPHCGRVAISETKRKEILEKMEKLERDGGNKWEVCEEVYKEASKVTICPHCGEIKYDIKFEKPTTYYRIDGNEEKTLTPSDVREILEKIPDEDCILLGLNPEVARPEWMVLTVLPVPPVTVRPSITLETGERSEDDLTHKLVDIIRINNRLEENIEGGAPNLIIEDLWNLLQYHVNTYFDNEAPGIPPAKHRSGRPLKTLAQRLKGKEGRFRYNLAGKRVNFSSRTVISPDPCLSINEVGVPEVVAKELTVPEKVTKYNIERIRQLLRNGSEKHPGVNYVIRKMIGRDGTEQEYKVKITESNKDFWAENIREGDIVERHLMDGDIVLYNRQPSLHRMSIMAHRVRVLPYRTFRHNLCV

SEQ ID NO: 780 - protein, 97 aa, Methanococcus jannaschii (Methanocaldococcus jannaschii DSM 2661)
  Mja RtcB (Mja Hyp-2) N-extein
MKDVLKRVSDVVWELPKDYKDCMRVPGRIYLNEILLDELEPEVLEQIANVACLPGIYKYSIAMPDVHYGYGFAIGGVAAFDQREGVISPGGVGFDIN

SEQ ID NO: 781 - protein, 99 aa, Methanococcus jannaschii (Methanocaldococcus jannaschii DSM 2661)
  Mja TFIIB N-extein
MVWLMEALKTKENETTKEKKLTTKVEKSEKKEENVREEEIVCPICGSKEVVKDYERAEIVCAKCGCVIKEKLFDIGPEWRAFDHEQKIKRCRVGAPMTY

SEQ ID NO: 782 - protein, 260 aa, Methanococcus jannaschii (Methanocaldococcus jannaschii DSM 2661)
  Mja UDP GD N-extein
MNISVIGTGYVGLIQAVGLAEFGFDVVGIDIDESKVKALNRGECPLYEEGLEGLLKKHVNKNLTFTTSYKPIKDSDVIFLCVGTPQDKDGNADLRFLFSAVEKIKETIDKEDYKVIVIKSTVPVGTNRRVKELLKDYNVDVVSNPEFLREGIAVYDFFNPERVILGFENLNNKKPIEIMEEVYKYFKDKNIPFVITNWETAELIKYASNAFLATKISFINELAKLSDKVKADIKTISYAMGLDPRIGNKFLNAGIGYGGS

SEQ ID NO: 783 - protein, 634 aa, Methanopyrus kandleri AV19
  Mka CDC48 N-extein
MPGLPIKLRVEKAYPEDVGKRAVRMDKASRDRIGVSEGDLVKITGSKTTVARVLPAKKEDVGKGIVRMDKYERQNAGASVGEPVEVDRAEEKVAKRVELMPTERVVVPVQAGLKEEVEEELTREHEQDILEQIKRYLRSRAQQTPIPATHRDVIPLEVQGKTIAGHVLIKFPDSLLVVGIEPEDATVIGPETEIEVKPYSEDLAKAAEIPDVTYDDIGGLDREIELIREYVELPLKRPELLKELGIKPPKGVLLYGPPGTGKTLLAKAVANECGAKFYSINGPEIMSKYYGESEARIREVFEEARKNAPAIIYIDEIDAIAPKRGETGEVERRVVAQLLTLMDGLSEDERVVVLASTNRPDDIDPALRRPGRFDKEIEIGVPDKEGRKEILQIHTRDMPLADDVDLDKLAELTHGFTGADLEALCKSAGLKALRRAIRKIGAKLAEKGEKEEREVAVKVSELSDEELMEVLEKGLDRARIPEEKKRALRRVLREAEEEEKEEVAYTDALDKVLEAEELPEIREELKVTMRDFMEALKEIEPSALREVIVEVPDVSWDDVGGLEDVKQELKEAVEYPLKYPEVYEKLGTRPPKGILLYGPPGTGKTLLAKAVANESDANFIAVRGPEVLSKWVGE

SEQ ID NO: 784 - protein, 82 aa, Methanopyrus kandleri AV19
  Mka RFC N-extein
MAEHELRVLEIPWVEKYRPKRLDDIVDQEHVVERLKAYVNRGDMPNLLFAGPPGTGKTTAALCLARELFGEHWRDNFLELNA

SEQ ID NO: 785 - protein, 100 aa, Methanopyrus kandleri AV19
  Mka RtcB N-extein
MAPKSMLKHIRNNVVWELPEDYKGCMKVPGRIYATEKLIDGMEKGVFDQVANVACLPGIYGYSIALPDAHYGYGFPIGGVAAFDVEEGVVSPGGVGYDIN

SEQ ID NO: 786 - protein, 260 aa, Methanopyrus kandleri AV19
  Mka VatB N-extein
MAEAERPAGKEYTTISEVSGPLMVVEGVEGAKYGEVVEVETPTGEVRRGQVLEARRDAAVVQVFEGTSGLDTTSTKVRFTGETLRIPVSTDLLGRILNGRGEPIDGGPEIVPEDELDIHGAPINPAARKYPSDFIQTGISAIDGMNTLVRGQKLPIFSGSGLPHNELAAQIARQATVPGEEEEFAVVFAAMGITHEEAAFFRREFEETGALDRAVLILNLADDPSMERIITPRIALTVAEYLAFENDMHVLVILTDMTNY

SEQ ID NO: 787 - protein, 65 aa, Mycobacterium kansasii
  Mkas GyrA N-extein
RPARSHAKSARSVAETMGNYHPHGDASIYDTLVRMAQPWSLRYPLVDGQGNFGSPGNVPPAAMRY

SEQ ID NO: 788 - protein, 233 aa, Mycobacterium leprae, strain TN
  Mle DnaB N-extein
MAVVDDLAHSGMDAVPPSEDFGRQPPQDLAAEQSVLGGMLLSKDAIADVLERLRSGDFYRPAHQNVYDAILDLYGRGEPADAVTVAAELDRRGLLRRIGGAPYLHTLISTVPTAANAGYYAGIVAEKALLRRLVEAGTRVVQYGYAGAEGADVAEVVDRAQAEIYDVAECRLSENYVPLEDLLQPTMDDLDAIASNGGISRGAPTGFTELDEVTNGLHPGQMIIVAARPGVGK

SEQ ID NO: 789 - protein, 205 aa, Mycobacterium leprae, strain TN
  Mle RecA N-extein
MAQVPDREKALELAMAQIEKNYGKGSVMRLGDEMCQPISVIPTGSIALDVALGIGGLPRGRIVEIYGPESSGKTTVALHAVANAQAVGGVAAFIDAEHALEPEYAKKLGVDTDSLLVSQPDTGEQALEIADMLIRSGALDIVVIDSVAALVPRAELEGEMGDSYVGLQARLMSQALRKMTGALSNSGTTAIFINQLREKIGVMFG

SEQ ID NO: 790 - protein, 256 aa, Bacteriophage Aaphi23
  MP-Aaphi23 MupF N-extein
MLMNLPEILKSQKKWKARKFRTVKTSKRTELWYRQQLKQFVKTMTDDIERALQQPQGSFFMDDAEGFKAISAKALLAYLEKYEKTDRTSQAENIAQGFVSRGDAQNQAEVSTNLKNQTGVDLAGYLRNSPNIAEKVNALTIDNVQLITNISSQYLDKVKSAVTRAMVSGSLNKDLAAQIKAIGQKTEKRAAFIARDQSSKLNAALTQARHEDLGVKKYMWSTAGDERVRDSHEELDGKVFSYDKPPEVGNPGHDFN

SEQ ID NO: 791 - protein, 140 aa, Mycobacteriophage Bethlehem
  MP-Be DnaB N-extein
MAVHYPESLLPAPSHIQGPTWRQYEDGSWFLPEKTLGWQIISWLFEYVNSPAGDGPFVPTLEQARFIAWWYAVDDQGKYAYREGTLRRMKGWGKDPMIGALALAELCGPVAFSHFDDNGNPVGKTRHAAWVTIAAVSQDQ

SEQ ID NO: 792 - protein, 94 aa, Mycobacteriophage Bethlehem
  MP-Be gp51 N-extein
MTQRIVFLPDTQLPYEARKEMQAVIRFIGDVQPYGVVHIGDILDLPQPSRWNKGTKGEFEGSVYRDADYAKKHLLEPLRKVYDGWIGAHEGNHD

SEQ ID NO: 793 - protein, 149 aa, Mycobacteriophage Catera
  MP-Catera gp206 N-extein
MGKEGRKSIFRSLAERDLLIPYFRNALLSQEWPDEYTIKVDSSPYYGKGDGYFHPSTHALMPARQLYYHFHPETRDKIVQEDRTITQEMTLTMGSAIHAVVQTQFQMAGLIKGPDDCEVEYVDRTHHVRGRVDFIVHHPNGQVIPVELK

SEQ ID NO: 794 - protein, 92 aa, Mycobacteriophage CJW1
  MP-Mcjw1 DnaB N-extein
MEVCGYTLDDIECTEVGAHFCVPRANKAQAFFEEILVHTKGQYTRKKFILEDWQRDDIVRPLFGRVEYSDEFGCYKRRYEIAWIELARKNGK

SEQ ID NO: 795 - protein, 106 aa, Mycobacteriophage Omega
  MP-Omega DnaB N-extein
MGVQEPRIWLSPEAKSSAGQEAIDLAAACGLILDPWQELCLHEALKESEELVQLESGAWVKKWAASSFGLVVSRQNGKGSILEALELAGLILFGERLIIHSAHEFK

SEQ ID NO: 796 - protein, 94 aa, Mycobacteriophage U2; identical to SEQ ID NO: 792
  MP-U2 gp50 N-extein

SEQ ID NO: 797 - protein, 9 aa, Mycobacterium shimodei
  Msh RecA N-extein
REKIGVMFG

SEQ ID NO: 798 - protein, 233 aa, Mycobacterium species KMS
  Msp-KMS DnaB N-extein
MAVVDDRGHPDMDAPPPSEDFGRQPPHDAAAEQAVLGGMLLSKDAIADVLERLRPGDFYRPAHQNVYDAVLDLYGRGEPADAVTVAAELDRRGLLRRIGGAPYLHTLISTVPTAANAGFYAGIVAEKALLRRLVEAGTRVVQYGYAGADGADVADVVDRAQAEVYDVVDRRSSEDFAVLESLLQPTMDEIDAIASQGGIARGVPTGFTELDELTNGLHSGQMVVIAARPGMGK

SEQ ID NO: 799 - protein, 130 aa, Mycobacterium species KMS
  Msp-KMS GyrA N-extein
MTDTTLPPGDEAGDRIEPVDIQQEMQRSYIDYAMSVIVGRALPEVRDGLKPVHRRVLYAMFDSGFRPDRGHAKSARSVAETMGNYHPHGDSSIYDTLVRMAQPWSLRYPLVDGQGNFGSPGNDPPAAMRY

SEQ ID NO: 800 - protein, 233 aa, Mycobacterium species MCS; identical to SEQ ID NO: 798
  Msp-MCS DnaB N-extein

SEQ ID NO: 801 - protein, 130 aa, Mycobacterium species MCS; identical to SEQ ID NO: 799
  Msp-MCS GyrA N-extein

SEQ ID NO: 802 - protein, 265 aa, Methanothermobacter thermautotrophicus (Methanobacterium thermoautotrophicum)
  Mth RIR1 N-extein
MISLSTTALKVLEERYLLRGEGGEVVETPEEMFRRVARAVASADEAYGDDPAVAEEAFYSVMGNLEFLPNSPTLMNAGTPINQLSACFVLPVEDSIDSIFSSLRDMAIIHKSGGGVGFSFSRLRPRGDIVASTMGVASGPVSFMRIFDVAVDVIKQGGRRRGANMGVLHVSHPDIFSFIDAKSREGPLRNFNLSVAVPDEFMDDRPVDLINPRNGEVVDSVESRVILKRIVEAAWRSGDPGILFEDRINRYNPTPQLGRIEATNP

SEQ ID NO: 803 - protein, 9 aa, Mycobacterium thermoresistibile
  Mthe RecA N-extein
REKIGVMFG

SEQ ID NO: 804 - protein, 252 aa, Mycobacterium tuberculosis strains H37Rv & CDC1551; identical to SEQ ID NO: 751
  Mtu SufB (Mtu Pps1) N-extein

SEQ ID NO: 805 - protein, 399 aa, Mycobacterium tuberculosis, CDC1551; identical to SEQ ID NO: 750
  Mtu-CDC1551 DnaB N-extein

SEQ ID NO: 806 - protein, 399 aa, Mycobacterium tuberculosis H37Rv; identical to SEQ ID NO: 750
  Mtu-H37Rv DnaB N-extein

SEQ ID NO: 807 - protein, 251 aa, Mycobacterium tuberculosis H37Rv,Also CDC1551; identical to SEQ ID NO: 752
  Mtu-H37Rv RecA N-extein

SEQ ID NO: 808 - protein, 251 aa, Mycobacterium tuberculosis So93/sub_species="Canetti"; identical to SEQ ID NO: 752
  Mtu-So93 RecA N-extein

SEQ ID NO: 809 - protein, 221 aa, Mycobacterium vanbaalenii PYR-1
  Mvan DnaB N-extein
MEPPPSEDFGRQPPQDAAAEQAVLGGMLLSKDAVADVLEKLRPGDFYKPANQLVYDAILDLYGRGEPADAVTVAAELDRRGLLRRVGGAPYLHTLISTVPTAANAGYYAEIVAEKSLLRRLVEAGTRVVQYGYAGADGADVNEIVDRAQAEIYDVTERKSSEDFVILEEILQPAMDEIDAIASEGGVSKGVPTGFTDLDELTNGLHPGQMIVVAARPGMGK

SEQ ID NO: 810 - protein, 400 aa, Nocardia farcinica IFM 10152
  Nfa DnaB N-extein
MTTTDDRGHTDFPPEPPGEDFGRQPPHDMAAEQSVLGGMLLSKDAIADVVEVIRPGDFYRPAHQAIYDTILDLYGRGEPADPVTVAAGLDRRGELKRIGGAPYLVTLTQTVPTAANAGYYAEIVAEKAILRRLVEAGTRIVQYGYAGADGQDIAEVVDRAQAEVYEVTERRTTEDFLPLEELLQPTMDEIDSIASRGGISLGVPTGFSELDELTNGLHPGQMIIVAARPGVGKSTLGMDFMRSCSIKHGLASVIFSLEMSRTEIVMRLLSAEAKIKLADMRSGRMSDDDWTKLARRMSEISEAPLFVDDSPNLTMMEIRAKARRLKQRHDLKLVVVDYLQLMTSGKKVESRQQEVSDFSRNLKLLAKELEVPVVAISQLNRGPEQRTDKRPMVSDLRESG

SEQ ID NO: 811 - protein, 156 aa, Nocardia farcinica IFM 10152
  Nfa RIR1 N-extein
MLNLYGPDGKIQFDKDREAARQYFLQHVNQNTVFFHNLDEKLDYLVEENYYEPEVLDRYSRAFVKSLFQQAYDKKFRFPTFLGAFKYYTSYTLKTFDGKRYLERFEDRVCMVALTLAAGDEELARKLVDEIIDGRFQPATPTFLNSGKKQRGEPVS

SEQ ID NO: 812 - protein, 14 aa, Neosartorya fischeri
  Nfi PRP8 N-extein
TAFPSWEGLFWERA

SEQ ID NO: 813 - protein, 54 aa, Neosartorya glabra FRR2163; identical to SEQ ID NO: 676
  Ngl-FR2163 PRP8 N-extein

SEQ ID NO: 814 - protein, 54 aa, Neosartorya glabra FRR1833; identical to SEQ ID NO: 676
  Ngl-FRR1833 PRP8 N-extein

SEQ ID NO: 815 - protein, 331 aa, Natronomonas pharaonis DSM 2160
  Nph CDC21 N-extein
MARAEDTEIIDKFEQFYRDYYRDEIGQLAQKYPEDQRSLYIDWDDLYRFDADLADDLVAQPDQIRDYAEEALRLYDLPVDVQLGRAHVRVHNLQQTTGIRDIRARHRGNLVEVTGIVRKATDVRPKITEAAFECQRCGTLTRIPQTAGDFHDPHECQGCERQGPFDINFDQSEFVDAQKIRVQESPEGLRGGETPQSIDVHIEDDITGKVTAGDHVRVAGVLHLDQQGSEQEKSPVFDVYMDGMSVEIEDEQFEDMDITDEDKQRIIELSNDDGIYQQMVESMAPSIYGYEQQKLAIIMQLFSGVTKDLPDGSRIRGDLHMLLIGDPGTGK

SEQ ID NO: 816 - protein, 518 aa, Natronomonas pharaonis DSM 2160
  Nph PolB-1 N-extein
MEQGTLGDFDTGASDDADAGRPAAEAAAVAGSDDGDASVVDVADYEFPDADGQIECAVTQVDYTVEGGGDDEHPVLHVFGRRPNDGDDEPLHIRVYGFKPYFYTPLSELDIADSAEAPLTEADIVDSRLDHDRLTGVETEADDGDGPNELVVYESIRGEKLVKVFGQTPRDVGQLRDRFEHYEADILFPNRLLIDKDITSGVRAPNRELDDGSLKVHHSELTATAVDAESRLHILDIEVDDRHGFPEDGEEEIVCLTSYDSYRDEYVIWLSESDDGVGGPEALGGYDPIGDGPLDVDVRRFDEEATMLVDYLDYIEDTDPDVLSGWNFDDFDAPYLIDRIDRIASRHDRLYSDRLSRVREVWDSGWGGPNIKGRVVFDLLYAYQRTQFSELDSYRLDAVGEEELGVGKERYPGDIGDLWEDDPERLLEYNLRDVELCVELNRKQNIVEFWEEVASFVGCKLEDATTPGDAVDMYVLHKIHGEFALPSKGHQEGEEYEGGAVFDPISGVKEMVSVLDLK

SEQ ID NO: 817 - protein, 1006 aa, Natronomonas pharaonis DSM 2160
  Nph PolB-2 N-extein
MEQGTLGDFDTGASDDADAGRPAAEAAAVAGSDDGDASVVDVADYEFPDADGQIECAVTQVDYTVEGGGDDEHPVLHVFGRRPNDGDDEPLHIRVYGFKPYFYTPLSELDIADSAEAPLTEADIVDSRLDHDRLTGVETEADDGDGPNELVVYESIRGEKLVKVFGQTPRDVGQLRDRFEHYEADILFPNRLLIDKDITSGVRAPNRELDDGSLKVHHSELTATAVDAESRLHILDIEVDDRHGFPEDGEEEIVCLTSYDSYRDEYVIWLSESDDGVGGPEALGGYDPIGDGPLDVDVRRFDEEATMLVDYLDYIEDTDPDVLSGWNFDDFDAPYLIDRIDRIASRHDRLYSDRLSRVREVWDSGWGGPNIKGRVVFDLLYAYQRTQFSELDSYRLDAVGEEELGVGKERYPGDIGDLWEDDPERLLEYNLRDVELCVELNRKQNIVEFWEEVASFVGCKLEDATTPGDAVDMYVLHKIHGEFALPSKGHQEGEEYEGGAVFDPISGVKEMVSVLDLKCFSGDTDVATPDGIKNIQEVAVGDPVYTLNPETFECEIKPVVDTQSYRNKYGELHHVAGRTHDFKVTENHRFLLSETVDLDSPGPDDYALSEYRELPEYERLAFPNHEPMAGATREEFDLAGAVDDGHAVVCAHDGRSAFRTAMPAGVEAALDRADGTSQLAATEEKTGTYRIPIDTYRERRDVIDEHADEVLLKYEREDNQIPTGFGMDDWLELVGWFVTAGRFAHEAKRIVLRRQDEEGRSAIRSLLERMELPYDADGTRVTVSNRVLYDWFVKNCGDGATETRLPEWVFELDAAHLRTLLETLVDGDGSRTDSGLGEFWTQSDRLKDDVVRLAVRCGEKPTVSENQDGTWYVSVGTRGSMKKSNATVEDHDGDVHCITAEDNHVVLAGRNGHLQWVGQSLYPMCMVTINASPETKVDPDNYGAETYAAPNGTHFRKEPDGVIREMVDELLEEREEKKSLRNEHEPSTDAYETYDRQQSAVKVIMN

SEQ ID NO: 818 - protein, 77 aa, Natronomonas pharaonis DSM 2160
  Nph rPol A'' N-extein
MTEITDDVEAIVEDTDLPRRLKDEVYETLESRSGVAPEDVEDIVQAVESQYLETRVDPLDPVGTVSAQSIGEPGTQM

SEQ ID NO: 819 - protein, 77 aa, Nostoc punctiforme
  Npu GyrB N-extein
MPYEKLEITTPAPVLSWANHSLGPEETKMAKNVASLPFVFKHVALMPDVHLGKGALVGSVIATKEAIIPAAVGVDIG

SEQ ID NO: 820 - protein, 38 aa, Neosartorya quadricincta, strain NRRL 4175
  Nqu PRP8 N-extein
AYRTDVIQALGGVETILEHTLFKATAFPSWEGLFWERA

SEQ ID NO: 821 - protein, 246 aa, Nocardioides species JS614
  Nsp-JS614 DnaB N-extein
MSVTEQGPRGLPEPPIDDWGDGPAAYAPGERPTSPGDRTPPQDMAAEQSVLGSMLISKDAIADVAEVLRGVDFYRPSHETIHDAIIDLYGRGEPVDMVTVAAELQRRGELQRIGGAPYLHTLSANVPIAANAGYYAEIVREKAILRRLVDAGTKIVQIGYAGEGQVDDIVDTAQAEVYKITDRRAAEDYAPLSDIMDGVLDEIEAIGNREAGLYGVPTGFADLDDLTNGLHSGQMIIVAARPAMGK

SEQ ID NO: 822 - protein, 61 aa, Nocardioides species JS614
  Nsp-JS614 TOPRIM N-extein
MAGRIRDEDIAEVREKARIDDVVSQYVTLRPAGGGSLKGLCPFHDEKSPSFNVNPSRGFFH

SEQ ID NO: 823 - protein, 275 aa, Nostoc species PCC7120, (Anabaena sp. PCC7120)
  Nsp-PCC7120 RIR1 N-extein
MVRELERKRQSARFPESAPAANPVFFRTYSRRTEAGLRETWDEVCDRTLKDLIELGKLSPEEVAILDKTQRNLTALPSGRWLWVGGTDWINKSKNFSGAYNCTSTNLQDWKAFGLMMNLAMMGCGTGAVIEPEYINQLPPIRNHLNIIVKGEIGTTPKHLRREYTQTHIEGNSATIYVGDSREGWVESYQALLELSTDERFTDEVQVFVDVSDVRQSGETLNGFGGVANPVKLPGLYQRCAAILNKALGRKLNSVECCLLIDEGAVTIVAGNIRR

SEQ ID NO: 824 - protein, 334 aa, Pyrococcus abyssi
  Pab CDC21-1 N-extein
MDREEIIERFLRFLREYAEEGEEPLYIGKIKDLLAITPKRSIAINWMHLNSFDPELAEEVLENPEECILAAEDAIQIILKEDIMREDVPRIHARFYNLPKTLMVKEIGAEHINKLIQVEGVVTRVTEIKPFVSSAVFVCKDCGHEMVVQQKPYEGFVAVKKCEKCGSKNVQLDVEKSKFVNFQMFRIQDRPETLKGGQMPRFIDGILLDDIVDTAMPGDRVVVVGILRVVQEKREKVPTFKKVIEVNYIEPVSKEIEELEITPEEEQKIRELAKRKDIVDAIVDSIAPAIYGYREVKKGIALALFGGVPRTLPDGTRLRGDIHVLLVGDPGVAK

SEQ ID NO: 825 - protein, 525 aa, Pyrococcus abyssi
  Pab CDC21-2 N-extein
MDREEIIERFLRFLREYAEEGEEPLYIGKIKDLLAITPKRSIAINWMHLNSFDPELAEEVLENPEECILAAEDAIQIILKEDIMREDVPRIHARFYNLPKTLMVKEIGAEHINKLIQVEGVVTRVTEIKPFVSSAVFVCKDCGHEMVVQQKPYEGFVAVKKCEKCGSKNVQLDVEKSKFVNFQMFRIQDRPETLKGGQMPRFIDGILLDDIVDTAMPGDRVVVVGILRVVQEKREKVPTFKKVIEVNYIEPVSKEIEELEITPEEEQKIRELAKRKDIVDAIVDSIAPAIYGYREVKKGIALALFGGVPRTLPDGTRLRGDIHVLLVGDPGVAKCVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHNSQLLRYIANLAPRAIYTSGKSSSAAGL

SEQ ID NO: 826 - protein, 20 aa, Pyrococcus abyssi
  Pab IF2 N-extein
MTKRIRQPIIAVLGHVDHGK

SEQ ID NO: 827 - protein, 453 aa, Pyrococcus abyssi
  Pab KlbA N-extein
MSEEKKKVRSWIDEILSGDNLTLEAILKKSESERKEEKKEETPLPKTESLSLASILAGVQKKEETEKETETLPFAVLEKTGGAPRLEDILKRSRPQERKEEGVGIQGILVPSSKYAGQVVRVLDVYGNVRIVRVKGEAVPIYEISVPELSREEEKLLKLVRDRAIVEIQIDPESIPNLEERRKVFLREVRKMVKEMAPTLSEGRVELLSELIVQNMIGYGKLDPLVRDDNLEEIMVIGIDRPVYVWHRRFGMCKTNIVFKTERELLTIIERIAREVGRRIDQQNPLLDARLPDGSRVNATLPPISLDGPTLTIRKFKKDPLTIIDLIKFRTLSSDVAAFLWLLVDGLGVKPANILVAGGTGSGKTTTLNSLAMFIPPSERVISIEDTAELQLPIEHWVRLETRPPNVEGKGEITMDDLVKNTLRMRPDRIIVGEVRGPEARTMFTAMNTGHDG

SEQ ID NO: 828 - protein, 220 aa, Pyrococcus abyssi
  Pab Lon N-extein
MLKFYKMGIKRLSGEMTMGEERMDLGIEFETTEEIPVPERLIDQVIGQDHAVEVIKTAAKQRRHVLLIGEPGTGKSMLGQAMAELLPTEDLEDILVFPNPEDENMPRIKTVPAGQGRRIVEEYKRKAKEQENIRFYLLFFVFFIVAMAVFMSRGDPNTLLLGVFVILIALMVTANMRFRTQAMVPKLLVDNSGRKRAPFVDATGAHAGALLGDVRHDPFQ

SEQ ID NO: 829 - protein, 155 aa, Pyrococcus abyssi
  Pab Moaa N-extein
MAETVGEIPSGEKEFEASTKRLREIIEFPELSEDEFHELLKSASRGYGSPLPHRTYSLCPETRRVVPAVVWEKDGKVWITKKCPEGMITDLYYEDVELYYRFSRWKFEEKKLFSVNVENTGVNCPFDCGLCARHRSHTSLLNIVLTNRCNLNCWY

SEQ ID NO: 830 - protein, 954 aa, Pyrococcus abyssi
  Pab Pol-II N-extein
MELPKEMEEYFEMLQREIDKAYEIAKKARAQGKDPSLDVEIPQATDMAGRVESLVGPPGVAKRIRELVKEYGKEIAALKIVDEIIEGKFGDLGSREKYAEQAVRTALAILTEGIVSAPIEGIANVKIKRNTWADNSEYLALYYAGPIRSSGGTAQALSVLVGDYVRRKLGLDRFKPSEKHIERMVEEVDLYHRAVTRLQYHPSPEEVRLAMRNIPIEITGEATDDVEVSHRDVPGVETNQLRGGAILVLAEGVLQKAKKLVKYIDKMGIEGWEWLKEFVEAKEKGEPKEEGKEESLAESTLEETKVEVDMGFYYSLYQKFKEEIAPSDKYAKEVIGGRPLFSDPSKPGGFRLRYGRSRASGFATWGINPATMILVDEFLAIGTQLKTERPGKGAVVTPVTTIEGPIVKLKDGSVLRVDDYNLALKVREDVEEILYLGDAVIAFGDFVENNQTLLPANYCEEWWILEFVKALKEIYEVHLEPFTENEEESIEEASDYLEIDPEFLKEMLRDPLRVKPPVELAIHFSEVLGIPLHPYYTLYWNSVEPKDVEKLWRLLKNYAEIEWSNFRGIKFAKKIVISQEKLGDSKRTLELLGLPHTVRDGNVIVDYPWAAALLTPLGNLNWEFMAKPLYATIDIINENNEIKLRDRGISWIGARMGRPEKAKERKMKPPVQVLFPIGLAGGSSRDIKKAAEEGKVAEVEIAFFKCPKCGHVGPEHLCPNCGTRKELLWVCPRCNAEYPESQAEGYNYTCPKCNVKLRPYAKRKIRPSELLNRAMENVKVYGVDKLKGVMGMTSGWKMPEPLEKGLLRAKNDVYVFKDGTIRFDATDAPITHFRPREIGVSVEKLRELGYTHDFEGKPLVSEDQIVELKPQDIILSKEAGRYLLKVAKFVDDLLEKFYGLPRFYNAEKMEDLIGHLVIGLAPHTSAGIVGRIIGFVDALVGYAHPYFHAAKRRN

SEQ ID NO: 831 - protein, 61 aa, Pyrococcus abyssi
  Pab RFC-1 N-extein
MRDMEEVREVKVLEKPWVEKYRPQKLEEIVGQEHIVKRLKHYVKTGSMPHLLFAGPPGVGK

SEQ ID NO: 832 - protein, 647 aa, Pyrococcus abyssi
  Pab RFC-2 N-extein
MRDMEEVREVKVLEKPWVEKYRPQKLEEIVGQEHIVKRLKHYVKTGSMPHLLFAGPPGVGKCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNTTAALALARELFGENWRHNFLELNASDERGINVIREKVKEFARTKPIGGASFKIIFLDEADALTQDAQQALRRTMEMFSSNVRFILS

SEQ ID NO: 833 - protein, 301 aa, Pyrococcus abyssi
  Pab RIR1-1 N-extein
MPVEKVMKRDGRIVPFDESRIRWAVQRAMWEVGVRDERKLDEVVKNIVKRINELYDGKIPHIENIQDIVELELMRAGLFEVAKAYILYRKKKAEIREEKKRILNKKELDEIDKRFSINALRVLASRYLKRDENGNIIESPRELFERVSILAVIPDLLYDERVFDKDGNYKQDLKRVEYYLENFEKFDGKYSIGKYKLNKYHFERMVNLYRELAEKGKMKVSIDEFLSMLERGEFDKYEKEIEEYFKLMTNQVFMPNTPALINSGRPLGMLSACFVVPIEDDMESIMKAAHDVAMIQKMGGG

SEQ ID NO: 834 - protein, 722 aa, Pyrococcus abyssi
  Pab RIR1-2 N-extein
MPVEKVMKRDGRIVPFDESRIRWAVQRAMWEVGVRDERKLDEVVKNIVKRINELYDGKIPHIENIQDIVELELMRAGLFEVAKAYILYRKKKAEIREEKKRILNKKELDEIDKRFSINALRVLASRYLKRDENGNIIESPRELFERVSILAVIPDLLYDERVFDKDGNYKQDLKRVEYYLENFEKFDGKYSIGKYKLNKYHFERMVNLYRELAEKGKMKVSIDEFLSMLERGEFDKYEKEIEEYFKLMTNQVFMPNTPALINSGRPLGMLSACFVVPIEDDMESIMKAAHDVAMIQKMGGGCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNTGLNFSKLRPEGDIVGTTTGAA

SEQ ID NO: 835 - protein, 1297 aa, Pyrococcus abyssi
  Pab RIR1-3 N-extein
MPVEKVMKRDGRIVPFDESRIRWAVQRAMWEVGVRDERKLDEVVKNIVKRINELYDGKIPHIENIQDIVELELMRAGLFEVAKAYILYRKKKAEIREEKKRILNKKELDEIDKRFSINALRVLASRYLKRDENGNIIESPRELFERVSILAVIPDLLYDERVFDKDGNYKQDLKRVEYYLENFEKFDGKYSIGKYKLNKYHFERMVNLYRELAEKGKMKVSIDEFLSMLERGEFDKYEKEIEEYFKLMTNQVFMPNTPALINSGRPLGMLSACFVVPIEDDMESIMKAAHDVAMIQKMGGGCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNTGLNFSKLRPEGDIVGTTTGAACFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNSGPVSFMHLIDAVSDVIKQGGVRRGANMGILEIWHPDIEKFIHAKEKNIGTNVLSNFNISVGIWEDFWEALKEGKKYPLINPRTGEVVKEIDPKTLFEELAYMAWAKADPGVIFFDIINRRNVLKEAKGGPIRATNP

SEQ ID NO: 836 - protein, 97 aa, Pyrococcus abyssi
  Pab RtcB (Pab Hyp-2) N-extein
MTVPLKRIDKIRWEIPKFDKRMRVPGRVYADDVLLEKMKSDRTLEQAANVAMLPGIYKYSIVMPDGHQGYGFPIGGVAAFDVNEGVISPGGIGYDIN

SEQ ID NO: 837 - protein, 240 aa, Pyrococcus abyssi
  Pab VMA N-extein
MVAKGRIIRVTGPLVVADGMKGAKMYEVVRVGELGLIGEIIRLEGDKAVIQVYEETAGVRPGEPVIGTGSSLSVELGPGLLTSIYDGIQRPLEVIREKTGDFIARGVTAPALPRDKKWHFIPKVKVGDKVVGGDIIGEVPETSIITHKIMVPPGIEGEIVEIAEEGEYTIEEVIAKVKTPSGEIKELKMYQRWPVRVKRPYKEKLPPEVPLITGQRVIDTFFPQAKGGTAAIPGPFGSGK

SEQ ID NO: 838 - protein, 463 aa, Pyrococcus furiosus
  Pfu KlbA N-extein
MGVYEVRKNMEEDKKKKKSWIDEILSSDNLSLESILKKSEEEKPKKVSVESKSLSLGDILSGRVKEEEKKREASPLQSLLGGGPPKLEEILKKEEPKREEKKPKIERGALGLQEILAGTTPRTTSYAGEVRVLDVYGNIRILKVKGEPVPIYEINMPKLSKEEERLVKMVRDRAIVEIQIDPESIPNPEERRKVFLREVRRMVKEMAPTLSEGRVELISELIVQNMIGYGKIDPLVRDDNLEEIMVIGINKPVYVWHRRFNMCKTNIVFTDERELLTIIERIAREVGRRIDQQNPLLDARLPDGSRVNATLPPISLDGPTLTIRKFKKDPLTIIDLIRFGTLNSEVAAFLWLLVDGLGVKPANILVAGGTGSGKTTTLNSLAMFIPPSERVISIEDTAELQLPIEHWVRLETRPPNVEGKGEITMDDLVKNTLRMRPDRIIVGEVRGPEARTMFTAMNTGHDG

SEQ ID NO: 839 - protein, 301 aa, Pyrococcus furiosus
  Pfu RIR1-1 N-extein
MAVEKVMKRDGRIVPFDESRIRWAVQRAMWEVGIRDEKKLDEVVKSIVQRINELYDGKIPHIENIQDIVELELMRAGLFEVAKAYILYRKKKAEIREEKKRILNKKELDEIDKRFSINALRVLASRYLKKDENGNIVESPRELFERVAILAVIPDLLYDERVFDKNGNYSQDLKRVEYYLEHFEEFDRKYSIGKYKLNKYHFERMVNLYKELAEQGKMKVSIDEFLAMLEKGEFNEYEKEINEYFRLMTNQIFMPNTPALINSGRPLGMLSACFVVPIEDDMESIMKAAHDVAMIQKMGGG

SEQ ID NO: 840 - protein, 914 aa, Pyrococcus furiosus
  Pfu RIR1-2 N-extein
MAVEKVMKRDGRIVPFDESRIRWAVQRAMWEVGIRDEKKLDEVVKSIVQRINELYDGKIPHIENIQDIVELELMRAGLFEVAKAYILYRKKKAEIREEKKRILNKKELDEIDKRFSINALRVLASRYLKKDENGNIVESPRELFERVAILAVIPDLLYDERVFDKNGNYSQDLKRVEYYLEHFEEFDRKYSIGKYKLNKYHFERMVNLYKELAEQGKMKVSIDEFLAMLEKGEFNEYEKEINEYFRLMTNQIFMPNTPALINSGRPLGMLSACFVVPIEDDMESIMKAAHDVAMIQKMGGGCIDGKAKIIFENEGEEHLTTMEEMYERYKHLGEFYDEEYNRWGIDVSNVPIYVKSFDPESKRVVKGKVNVIWKYELGKDVTKYEIITNKGTKILTSPWHPFFVLTPDFKIVEKRADELKEGDILIGGMPDGEDYKFIFDYWLAGFIAGDGCFDKYHSHVKGHEYIYDRLRIYDYRIETFEIINDYLEKTFGRKYSIQKDRNIYYIDIKARNITSHYLKLLEGIDNGIPPQILKEGKNAVLSFIAGLFDAEGHVSNKPGIELGMVNKRLIEDVTHYLNALGIKARIREKLRKDGIDYVLHVEEYSSLLRFYELIGKNLQNEEKREKLEKVLSNHKGGNFGLPLNFNAFKEWASEYGVEFKTNGSQTIAIINDERISLGQWHTRNRVSKAVLVKMLRKLYEATKDEEVKRMLHLIEGLEVVRHITTTNEPRTFYDLTVENYQNYLAGENGMIFVHNTGLNFSKLRPEGDIVGTTTGAASGPVSFMHLIDAVSDVIKQGGVRRGANMGILEIWHPDIEKFIHAKEKNIGTNVLSNFNISVGIWEDFWEALKEGKKYPLINPRTGEVVKEVDPKTLFEELAYMAWAKADPGVIFFDVINRRNVLKKAKGGPIRATNP

SEQ ID NO: 841 - protein, 240 aa, Pyrococcus furiosus
  Pfu VMA N-extein
MPAKGRIIRVTGPLVIADGMKGAKMYEVVRVGELGLIGEIIRLEGDKAVIQVYEETAGLKPGEPVEGTGSSLSVELGPGLLTSIYDGIQRPLEVLREKSGHFIARGISAPALPRDKKWHFTPKVKVGDKVVGGDIIGEVPETSIIVHKIMVPPGIEGEIVEIADEGEYTIEEVIAKVKTPSGEIKELKMYQRWPVRVKRPYKEKLPPEVPLVTGQRVIDTFFPQAKGGTAAIPGPFGSGK

SEQ ID NO: 842 - protein, 334 aa, Pyrococcus horikoshii OT3
  Pho CDC21-1 N-extein
MEREEIIERFLKFFREYAEEGEEPLYMGKIKDLLTITPKRSIVINWMHLNSYDPELAEEVIENPEECILAAEDAIQIILKEDFLREDVPKIHARFHNLPKTLMVKEVGAEHINKLIQVEGVVTRVTEIKPFVSVAVFVCKDCGHEMVVPQKPYEGFVAVKKCEQCGSKNVQLDVEKSKFVNFQMFRIQDRPESLRGGQMPRFIDGILLDDIVDTAMPGDRVIVVGILRVIQEKREKVPTFKKVIEVNHIEPISKELEELEISPEDEQKIRELAKRKDIVSAIVDSIAPAIYGYKEVKKGIALALFGGVSRTLPDGTRLRGDIHVLLVGDPGVAK

SEQ ID NO: 843 - protein, 529 aa, Pyrococcus horikoshii OT3
  Pho CDC21-2 N-extein
MEREEIIERFLKFFREYAEEGEEPLYMGKIKDLLTITPKRSIVINWMHLNSYDPELAEEVIENPEECILAAEDAIQIILKEDFLREDVPKIHARFHNLPKTLMVKEVGAEHINKLIQVEGVVTRVTEIKPFVSVAVFVCKDCGHEMVVPQKPYEGFVAVKKCEQCGSKNVQLDVEKSKFVNFQMFRIQDRPESLRGGQMPRFIDGILLDDIVDTAMPGDRVIVVGILRVIQEKREKVPTFKKVIEVNHIEPISKELEELEISPEDEQKIRELAKRKDIVSAIVDSIAPAIYGYKEVKKGIALALFGGVSRTLPDGTRLRGDIHVLLVGDPGVAKCVDYDTEVLLGDGRKRKIGEIVEEAIKKAEKEGKLGRVDDGFYAPINLELYALDVRTLKVRKVKADIAWKRTTPEKMLRIRTKRGREIRVTPTHPFFTLEEGRIKTKKAYELKVGEKIATPREEAPEAEIFWDEVVEIEEYKPNNSWVYDLQVPEHHNFIANGIFVHNSQLLRYVANLAPRAIYTSGKSSSAAGL

SEQ ID NO: 844 - protein, 22 aa, Pyrococcus horikoshii OT3
  Pho IF2 N-extein
MSYVKRIRQPIIAVLGHVDHGK

SEQ ID NO: 845 - protein, 451 aa, Pyrococcus horikoshii OT3
  Pho KlbA N-extein
MSEKEEKKRARSWIDEILSSDNLTLEAILKKSSGEGKSTPEKPKTESLSRGNILPTPSPQKQEAGEGLPLAFLEKTGALRLEDILKKPEEERKEEEVPIRIQEILTPPTSKKYTGQILKVLDVYGNVRIIRVKGEAVPIYELSIPELSKDEEKLLKLVRDRAIVEIQIDPESIPNLEERRRIFLREVRKMVKEMAPTLSEGRVELLSELIVQNMIGYGKLDPLVRDDNLEEIMVIGTNRPVYVWHRRFGMCKTNITFTSEREILTIIERIAREVGRRIDQQNPLLDARLPDGSRVNATLPPISLDGPTITIRKFKKDPLTIIDLIKFRTLNSEVAAFLWLLVDGLGVKPANILVAGGTGSGKTTTLNSLAMFIPPSERVISIEDTAELQLPIEHWVRLETRPPNVEGKGEITMDDLVKNTLRMRPDRIIVGEVRGPEARTMFTAMNTGHDG

SEQ ID NO: 846 - protein, 346 aa, Pyrococcus horikoshii OT3
  Pho LHR N-extein
MMGNVRWAKRKYTDDEIYSILDPLVREWFKRKFNSFTPPQRYAIVEIHKGENVLISSPTGSGKTLSAFLAIISELISLGRKGKLEDKIYCVYISPLRALNNDIRRNLEEPLREIKELAQELGEEIPEIRIAVRTSDTSSYEKSKMVKKPPHILITTPESLAIALNAPKFRERLRDVRWVIVDEVHALAENKRGSHLALTLERLRELVGRDFVRIGLSATIHPLEEVAKFVFGFNDDGTPRSGLIVDVSFAKQTEIKVESVVEDLIYTDAETLSNALYNRLAELIRKHKTTLIFTNTRSGAERVAFNLKKRFPEFKGLIETHHSSLSREVRLDVEEKLKRGELRAVV

SEQ ID NO: 847 - protein, 210 aa, Pyrococcus horikoshii OT3
  Pho Lon N-extein
MLSGESEMDEERMDLGIEFETTEEIPVPERLIDQVIGQDHAVEVIKTAAKQRRHVLLIGEPGTGKSMLGQAMAELLPTEELEDILVFPNPEDENMPRIKTVPAGQGRKIVEEYRRKAKEQEGVRFYLLFFVFFIVAMAVFLSHGDPNTLLLGVFVILVALMVTANMRFKTQAMVPKLLVDNSGRKRAPFVDATGAHAGALLGDVRHDPFQ

SEQ ID NO: 848 - protein, 492 aa, Pyrococcus horikoshii OT3
  Pho Pol I N-extein
MILDADYITEDGKPIIRIFKKENGEFKVEYDRNFRPYIYALLRDDSAIDEIKKITAQRHGKVVRIVETEKIQRKFLGRPIEVWKLYLEHPQDVPAIRDKIREHPAVVDIFEYDIPFAKRYLIDKGLTPMEGNEKLTFLAVDIETLYHEGEEFGKGPVIMISYADEEGAKVITWKKIDLPYVEVVSSEREMIKRLIRVIKEKDPDVIITYNGDNFDFPYLLKRAEKLGIKLLLGRDNSEPKMQKMGDSLAVEIKGRIHFDLFPVIRRTINLPTYTLEAVYEAIFGKPKEKVYADEIAKAWETGEGLERVAKYSMEDAKVTYELGREFFPMEAQLARLVGQPVWDVSRSSTGNLVEWFLLRKAYERNELAPNKPDEKEYERRLRESYEGGYVKEPEKGLWEGIVSLDFRSLYPSIIITHNVSPDTLNREGCEEYDVAPKVGHRFCKDFPGFIPSLLGQLLEERQKIKKRMKESKDPVEKKLLDYRQRAIKILAN

SEQ ID NO: 849 - protein, 954 aa, Pyrococcus horikoshii OT3
  Pho Pol-II N-extein
MVLMELPKEMEEYFSMLQREIDKAYEIAKKARAQGKDPSLDVEIPQASDMAGRVESLVGPPGVAERIRELVKEYGKEIAALKIVDEIIDGKFGDLGSKEKYAEQAVRTALAILTEGVVSAPIEGIASVKIKRNTWSDNSEYLALYYAGPIRSSGGTAQALSVLVGDYVRRKLGLDRFKPSEKHIERMVEEVDLYHRTVSRLQYHPSPEEVRLAMRNIPIEITGEATDEVEVSHRDIPGVETNQLRGGAILVLAEGVLQKAKKLVKYIDKMGIEGWEWLKEFVEAKEKGEEIEEEGSAESTVEETKVEVDMGFYYSLYQKFKSEIAPNDKYAKEIIGGRPLFSDPSRNGGFRLRYGRSRVSGFATWGINPATMILVDEFLAIGTQLKTERPGKGAVVTPVTTIEGPIVKLKDGSVVKVDDYKLALKIRDEVEEILYLGDAVIAFGDFVENNQTLLPANYCEEWWILEFTKALNEIYEVELKPFEVNSSEDLEEAADYLEVDIEFLKELLKDPLRTKPPVELAIHFSEILGIPLHPYYTLYWNSVKPEQVEKLWRVLKEHAHIDWDNFRGIKFARRIVIPLEKLRDSKRALELLGLPHKVEGKNVIVDYPWAAALLTPLGNLEWEFRAKPLHTTIDIINENNEIKLRDRGISWIGARMGRPEKAKERKMKPPVQVLFPIGLAGGSSRDIKKAAEEGKVAEVEIALFKCPKCGHVGPEHICPNCGTRKELIWVCPRCNAEYPESQASGYNYTCPKCNVKLKPYAKRKIKPSELLKRAMDNVKVYGIDKLKGVMGMTSGWKMPEPLEKGLLRAKNDVYVFKDGTIRFDATDAPITHFRPREIGVSVEKLRELGYTHDFEGNPLVSEDQIVELKPQDIILSKEAGKYLLKVAKFVDDLLEKFYGLPRFYNAEKMEDLIGHLVIGLAPHTSAGIVGRIIGFVDALVGYAHPYFHAAKRRN

SEQ ID NO: 850 - protein, 953 aa, Pyrococcus horikoshii OT3
  Pho r-Gyr N-extein
MKAIYRGMCPNCRGAITDERLSNKNPCEGCLSEPILSEDYNELIVAVRNALKLRGTLKDWEELYRLNKEVSEIEELFEKSTGFKFWSAQRTWVKRIIRGKSFSIIAPTGMGKSTFGAFISIYFATKGKKSYIVVPTTPLVIQTVKKIESMLEKANVSVRLVYYHGNLRKKEKEEALEKIRNGDFDILITSSQFLATRFKELLKDKKFDLIFVDDVDAFLKASKNIDRSLIMLGFSEEIIGRAWEVIKLKKQLAKLLQNEKKNEEEIEKLNKEIEKIEDEIEEYKRRNKIGILIVASATGSAKGDRIKLYRELLGFEVGSGRSVLRNIVDTYLLPEKPIEEHVVELLRKLGKGGLIFVPIDKGIEYAEELTDYLKSQGFKVELVSAKNKKGLELFEKGEIDYLVGVATYYGTLVRGLDLPHLIRFAIFTGVPKFRFSMDLEQPTIYRVLGLMSEILEFLPEEKKSEGEKLYARLRRLIRNIPQYELMKIEEALAEGLELEGFHNHVLEVFKQSVEFLREVLKDEEVIKKIAENPFLSLKEIEGKLYIEIPDVRTYIQASGRTSRLFAGGITKGLSVIIVDDQKVFNGLIRQMRWRFVEFDIKKFEEVNLKEVLKEIDRDREKVKLVIEGKISEQVKDLVKSALMIVESPNKARTIASFFGQPSKRKIGDLTAYEVSIGDKMLTILASGGHMFDLVTNEGYHGVLILKNNGKPYFVPVYDTIKRCRDCGHQFVDWEQKGVCPRCGSRNVHDALENVKAMRELALEVDEILIGTDPDTEGEKIAWDIRNVLAPYAPNIKRIEFHEVTRPAILRAIREARDINEDRVNAQLVRRIEDRWIGFELSQKLWEVFENRNLSAGRVQTPVLGWIVQRYKEFTESETDFLGIILENGINVTIENAKGEVREVEVKDVIIEEKDVNPLPPYTTDTMLQDASRFLGFSATKTMQLAQDLFEAGL

SEQ ID NO: 851 - protein, 152 aa, Pyrococcus horikoshii OT3
  Pho RadA N-extein
MMIMVKKGSDPEVVEIDEIEGLGLELEEESTTSKKKKKEKEIKSIEDLPGVGPATAEKLREAGFDTLEAIAVASPIELKEVAGISEGAALKIIQAARKAANLGTFMRADEYLKKRESIGRISTGSKSLDKLLGGGIETQAITEVFGEFGSGK

SEQ ID NO: 852 - protein, 61 aa, Pyrococcus horikoshii OT3
  Pho RFC N-extein
MHNMEEVREVKVLEKPWVEKYRPQRLDEIVGQEHIVKRLKHYVKTGSMPHLLFAGPPGVGK

SEQ ID NO: 853 - protein, 467 aa, Pyrococcus horikoshii OT3
  Pho RIR1 N-extein
MKCRGVIMVVEKVMKRDGRIVPFDESRIRWAVQRAMWEVGVRDEKKLDEVVKAIVQRINELYDGKIPHIENIQDIVELELMRAGLFEVAKAYILYRKKKAEIREEKKRILNKKELDEIDKRFSINALRVLASRYLKRDENGNIIESPRELFERVAILAVIPDLLYDERVFDKDGNYSQDLKRVEYYLEHFEEFDGKYSIGKYKLNKYHFERMVNLYKELAEKGKMKVSIDEFLGMLERGEFNKYEKEIDEYFRLMTNQIFMPNTPALINSGRPLGMLSACFVVPIEDDMESIMKAAHDVALIQKAGGGTGINFSKLRPEGDIVGTTTGAASGPVSFMHLIDAVSDVIKQGGVRRGANMGILEIWHPDIEKFIHAKEKNIGTNVLSNFNISVGIWEDFLEALKEGKKYPLINPRTGEVVREVDPKSLFEELAYMAWAKADPGVIFFDIINRRNVLKEAKGGPIRATNP

SEQ ID NO: 854 - protein, 240 aa, Pyrococcus horikoshii OT3
  Pho VMA N-extein
MVAKGRIIRVTGPLVVADGMKGAKMYEVVRVGELGLIGEIIRLEGDKAVIQVYEETAGVRPGEPVVGTGASLSVELGPGLLTSIYDGIQRPLEVIREKTGDFIARGVTAPALPRDKKWHFIPKAKVGDKVVGGDIIGEVPETSIIVHKIMVPPGIEGEIVEIAEEGDYTIEEVIAKVKTPSGEIKELKMYQRWPVRVKRPYKEKLPPEVPLITGQRVIDTFFPQAKGGTAAIPGPFGSGK

SEQ ID NO: 855 - protein, 453 aa, Pelodictyon luteolum DSM 273
  Plut RIR1 N-extein
MKISRLFTSPGENVYDRFEYTQKSSVLRNTDGSKVFEMNELEVPKHWSQMAADILAQKYFRKTGVPQVDGDGNPLLDEEGRPVTGSEHSIRQVVHRLAGCWRQWGEKHGYFDSPEDAEAFYDEVAYMLIAQQGAPNSPQWFNTGLNFAYGITGPAQGHYHVDPATKKVVESEDAYTRPQAHACFIQSVNDDLVNEGGIFDLAVREARVFKFGSGSGTNYSNLRSSGEKLSGGGSSSGLMSFLKIFDSAAGAIKSGGTTRRAAKMVIIDIDHPDVEKFIEWKAREEDKVASLVAGSRICSRFLQAIVEEAILNGADRLENPKLQRLIENALHRAVPMSYIIRVLALVEQGYTTLDFEEYDTHYESEAYQTVGGQNSNNTVRVTNAFMKAVENNELWMLKERTTGKTARAVNARELWEKILLSAWKCADPGLQFDTTINEWHTCPAAGRINASNP

SEQ ID NO: 856 - protein, 297 aa, Polaromonas naphthalenivorans CJ2
  Pna RIR1 N-extein
MKREHFGRPQDLTATQPISHDVLKEKYLKPGESGVEDVYRRVARALASVELPAEREKHEALFLENLHAGAIGAGRIMSAAGTAIQATLINCFVQPVGDCIQGVDDGGYPGIYEALREAAETMRRGGGVGYDFSRIRPRGAEVKATASMASGPCSYINVFDQSCSTVESAGARRGAQMGVLRIDHPDVHEFITAKRTPGRWNNFNVSVGMSDGFMQALNDDQPWELVHKAKPGAALMAKGAFQRADGLWVYQTVAAREMWDTVMRSAYDFAEPGILFLDNINTDNNLRYCEAIAATNP

SEQ ID NO: 857 - protein, 297 aa, Polaromonas species JS666
  Posp-JS666 RIR1 N-extein
MKREHFGQPHDVTATQPISHDVLKEKYLKPGENGVEDLYRRVARALASVEPEAARAEHEALFLENLHAGAIGAGRIMSAAGTSIQATLINCFVQPVGDCIQGMDDGGYPGIYEALREAAETMRRGGGVGYDFSRIRPRGAEVKATASMASGPCSYINVFDQSCSTVESAGARRGAQMGVLRIDHPDVFEFITAKRTPGRWNNFNVSVGVSDAFMQALGDDQPWELVHRAKPGARLIAQGAFQRADGLWVYQTLAASELWDTVMRSAYDFAEPGILFLDHINQDNNLRYCESIEATNP

SEQ ID NO: 858 - protein, 151 aa, Pseudomonas aeruginosa phage phiEL
  PP-PhiEL Helicase N-extein
MLGLFSVKIKQTGDYVHITGVSYYDLAKDIEKFYSTSLLTKHQIRRESWDTIKVHNFFLVELHHIVGELLKIRNLRTRRRALSELKELIETETWIKDTVNPGGKPFDLKKLNQFNTVPFPQQLDFLQQYPIIVNSYHLKGMLLDAKPGSGK

SEQ ID NO: 859 - protein, 181 aa, Pseudomonas aeruginosa phage phiEL
  PP-PhiEL ORF11 N-extein
MTDEQDTSLSYAKWLVKYLRCNNLPKELIDDKRLRIDWEARTDDETLLAHFNEDSLSGIKTVRFLKDFFNYQAGYDRETRNTSFLRTTEVFRQQGINNFYFILQLNNPLLKGVDPFDPNLTPEQQVWVLEECRSNFWYFLREVCRLKPNQPFLANRGNISFIWSYLNHITTYMIMPRQQGK

SEQ ID NO: 860 - protein, 246 aa, Pseudomonas aeruginosa phage phiEL
  PP-PhiEL ORF39 N-extein
MVMKIKLREWANLPEETVLRWLNTRRWVEVTDDLDQVALTDTYALIITWHGMIIHRHYNDVPYSIKEMVPSNKVEGGEDTVYNDGTNATPINQFLKVILPTIIDPVEVDGIKRLIHIWQNKLNNLLVVMSERYVISATAESVAEFMEDEGISGIRDRVLSKEISIDEGEREFADYVRTAHSIANNTLTLLSRTGGVAINQAYQKTIIRGKVFDLNNSIMPNAITVPYAHGITNLADMLGERNAAGK

SEQ ID NO: 861 - protein, 144 aa, Pseudomonas aeruginosa phage phiEL
  PP-PhiEL ORF40 N-extein
MRATATISKANHYFRINGFYEEFAVRVILPFCKLNLCKMAKKPIPGTRKQAWFVQHVFARSNYDKSEYRLPIETLKEFVEFAGYRGYKESRLKIQDEPEIEGKDVVFEFNPGFDQFREGQGEWIEYMLSDGHLKVNNASTGFGK

SEQ ID NO: 862 - protein, 361 aa, Porphyra purpurea (chloroplast)
  Ppu DnaB N-extein
MLTQESEDLLKQIEKLSPDFFYFKSNSLVYRAILETVNPIDKIALVSLLTALNTNNLIRQLGRLETIMKLIENSPASNIIYEYSKVILDNYVKRLLLKSGDSLCLISCSKKQITQSVITSVASQLTIAYEILEDEGTYTLAEIFASLLVSLDTKKKISINSGIFSGFWQLDLITNGFQKSDLIIIAGRPSMGKTAFAINITRHIIKTSQYYVILFSLEMSTEQLLRRILAQECHLNSQKIQSGQLTNVEWQRIVEESKILANLNFYIDDSAEISCDIIKVKVKLLRLQGKKIKLIIIDYLQLLQESKKSENRSQELSLITRSLKILARELNLPILVLSQLNRNLESRHNKRPLLSDLRESG

SEQ ID NO: 863 - protein, 492 aa, Pyrococcus species GB-D
  Psp-GBD Pol N-extein
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILAN

SEQ ID NO: 864 - protein, 282 aa, Pichia stipitis CBS 6054, taxon:322104
  Pst VMA N-extein
MAGALENARKEIKKLSLDADESLYGQIYSVSGPVIIAENMIGCAMYELVKVGHDTLVGEVIRISGDKATIQVYEETAGVTVGDPVLRTGKPLSVELGPGLMETIYDGIQRPLKAIKEQSQSIYIPRGIDAPALSRTVNYDFTPGSLKVGDHITGGDIFGSIYENSLLDDHKILLPPRARGTITSIAEAGSYNVDDNVLEVEFDGKKHSYSMMHTWPVRVPRPVAEKLAADYPLLTGQRVLDSLFPCVQGGTTCIPGAFGCGKTVISQSLSKFSNSDVIIYVG

SEQ ID NO: 865 - protein, 5986 aa, Pseudomonas syringae pv. tomato str. DC3000
  Psy Fha N-extein
MDVHQLALLARQPSAVLTERRSFWGMPKRGLALILANAMFWQPLLVQAEGIVVSGPNTSLSQAGNGVPIVNIATPNASGLSHNQYQQFNVESQGVILNNSTNQTQSTQLGGIIVGNSNLRGTAATTILNEVVGANASQLKGYTEVAGQAARVIVANPYGISCNGCGFINTPQVTLTTGKPVLDANGQLQRFNVQGGSISIDGVGLNADNVDQFDIITRSAKINAELHARRLNIIAGRNDVDAQTLNATALADDGGAKPELAIDSSALGGMYAGTIRLVGTEAGVGVRLAGNLAASGGDIQIDANGHLNVMQTAASAAVTVKANSAEVNGPVYAGASLAVTTAGDLVTRQNVAARDALTLSAGGQLNNSAVIEAGVNADNSRNGSGDVTLSANGLSNSGSITASRALQATVTQVLNNQGATLNGQASTRIAAAAIDNRQSGRILSQSGSVDINASQVLNSQSGLISSSGSLTITAGSLDNSQQGKLSSSSALSARISGQFLNQLGLVSANGYLLLNAATLDNRSAEISSLGNLTSTVGQFNNSEKGRLLANGSLQLTSDTLNNQNGSLAGQQNVQLTLGQLTNTGNGSVYGKNNLNLTLNGALNNDQGALRSDGTLDVRAASLSNNSGSTTSAGAASVTTSGAVVSRGGQILSDAGLTLISGSLDNSQSGRIAGNGVVLSTGAFDNQRSGNLSSTGTLQLTAAQVNNSDAGRIASAMALTAVVTGLNQTNDGRVYSNTDVSLDLSNGLLTNQGGLINAPGQLVLKNLNVVNNQSGKISSANGFTLAATSLDNTDGSLLSDKALVVRVNQLLTNLRGLVSATGLDLTAGSLNNRNGEISSLGGLTANIGQFDNREKGRLLANGALLLTADGLNNLNGIVSGQQGVQLNLGQLDNTGSGSLYAKSSLGLNVSGTLNNDQGVVRSDGTMDLKAAGLANTNGSVTSAGTGVLNFNGAAVNQGGQIVSDAQLTLTSGSLDNSQRGRIAGNGVLLSTGTFNNQQGGSLSSTGALRLTAGQVDNSAAGRIASAMALTAVVTGLNQTNDGRLYSNSDVSLDLSNGLLTNQGGLINAPGQLVLKNLSVVNNQSGKISSANGFTLAATSLDNTDGSILSDKALVVRVNQLLTNLRGLVSATGLDLTAGSLNNRNGEISSLGNLTANIGQFDNREKGRLLANGALLLTADGLNNLNGVVSGQQAVQLNLGQLNNTGAGSLYAKNALNLTLGGVLANDQGVVRSDGTMDLKAAGLANTNGSVTSAGTGVLNFNGAAVNQGGQIVSDAQLTLTSGSLDNSQRGRIAGNGVLLSTGTFNNQQGGSLSSTGALRLTAGQVDNSAAGRIASAMALTAVVIGLNQTNDGRLYSNTDVSLDMSNGLLNNQSGQISAPGQLLLKNLNVVNNQSGKISSANGFTLAATSLDNTDGSLISDKALIVRINQLLNNVRGQISASGVTLSAATLDNRNAELSSLGNLTANIGQFDNREKGRLLANGALLLTADGLNNLNGIVSGQQGVQLNLGQLTNTTGGSIYAKSSLGLTVIGAVNNDQGVLRSDGSLTLRAASLTNNAGSISSAGVASINVDGDVVNRGGQVLSDATLTLTSASLDNSQSGRIASKGLVLTTGVFDNHQDGRLTSTGELQLNAGLVNNSDAGRIASAMALTAVVTGLNQTRDGRLYSNSDVSLDLSNGVLTNQGGLINAPGQLLLKNLTSVSNRKGEISSANGFTLAATSLDNTEGSLLSDKALVVRINQWLTNLRGKISANGVNLSAATLDNRNAELSSLSTLTATLGGFDNTDKGRLLANGALLLTADTLNNQNGIVSGQQDMQLNLGQLSNTGAGSVYAKNRLGLTLTGALNNDQGVLRSDGALDLKAGSLANTGGSVTSAGVSGLATDAAVVNQGGQILSDATLTLTSASLDNSQSGRIASKGLVLTTGAFDNHQDGRLISTGTLQLNAGQVNNSEAGRIASAMALTAVVTGLDQTSDGRLYGNGDVSLDLSNGVLTNQGGQLSAPGQLLLKNLSSVNNRSGKISSANGFTLAATTLDNTAGSVISDKALIVRIDQLLTNLRGLISATGVELNAATLDNRNAELSSLGKLTATVGQFDNSGKGRLLANGALLLTADNLNNQGAGAVSGQQEVQLTLGQLTNIGSGSVYAKNTLGLTVSGALNNNQGVVRSDGTLDVSGASLANTAGSITSTGVSVLKVDGAVVNRGGQILSDSTLSLSSASVDNSQNGRIAGKGVTLATGAFDNQQGGRLTSTGTLKIDAGQVNNSDAGRIASAMALTAVVTGLDQSNDGRLYGNGDVSLDLSKGVLNNQGGLITAPGQLLLKNLTSVNNQNGEISSAKGFTLAATSLDNTAGSVLSDSALIVRVDQLLTNLRGLVSGNGIDLTANELNNQSGSVSSDADLLLTIAGTLSNQKGELTSAGNTTLNALSLANANGQVMADRFLKLVITDAIDNQAGTLGAGKGADIRAVSLDNRQAGALVTDGQLDLTLTDALDNRASGSLQAKGLMNLTSQTLDNRGGRITAQNMLMVRSASVDNRGGAIRAEKGLQLFVDALDNSQSGLSTAQKGLINSNAGLELVGTRLDNQNGLLNAAGLMQLQADSVLNGSGRIASQADLVAHIGGLTQQGGELVAQGNLTLTGNILDNQSGGLVGSTKALKIDVADIDNKAGELSSQIGVEIIAQTLDTSNGGKVLAGTALGLTVARLINLNKGLLFGNTLRLEGTRLDNAGGTLASQQDLNIGLSGALDNTGGLLSSESAMTVSAASLQNAAGSLSSADALSVTTTGALSNQAGSITTDAALTLTSASLDNSKAGKLSGKGATQVTTGTFDNSQNGRLTSSDTLRLTAGKVINQSAGRIASALALTASVTSLDQQAGELFSNTSLSLDLNNGQLNNQGGLINASGVLLLKNLNGIANQNGEISSAQAFSLNASSFDNSGGKLLSSQALTLVVNKALSNLKGNISGASLNINSDSLDNTQGMISSRAGLDVTVNTALTNAQGTLIGDGNVNLSAATADNRQGQMASKQNLDAQIGNLQQQNGQMLAQGTLTLRGDTLDNRQNGFIGATQALAINVTNIDNRGGELSSQDTMTLTGQQLNNSDKGQVLAQKALTLNIAQTTNRANGLLSSQAGLTLIGSTLDNTGGALSALKALGIDLSAALDNSQGLISGEDILTLNAGSLTNTAGSVSSAANLKLDSAGAISNQGGKLVTDGALNLTSTRLDNSQRGTISGKGLLTLKTGNFDNSQNGRVSSNDRLELTSAQLTNSSGGSIGSSQALTASVSRLSQQGGKLFSNTSLSLDLNNGQLDNQNGLINAPGALVLKNVNEVLNQNGEISSAQAFTVNAQQLNNTGGKLLSNQLLTLRIARALNNVKGMIAAAGVDAVVNTLDNTGGTLTSRNDLGLTVAGLLTNRDNGLINATQALKVGAASLDNQNGQVLGGTSLILNATSINNTAKGLINSTGTLNLTAGSLDAGNGGEVSAARDMTLVLNALSLNGGRVMGDAGLSIDMVGNDLNNLGGLITADGQLTFSRLRDLNNQSGEVSSAQSFTLSGRTLDNSSGKLISSNVLTVGATNLLNQNGLISGWQGLNVSGNRLDNRNSGTLSSRSGNLVTTLTGELLNGGNGALVSQNTLSVTADSLDNSGGILSSGTGQTLTVSGLLNNSQNGLIDSGAGLVINANALNNAAGNMTAQQDVSFGGSSLDNSAGNLSSKGAMTLDLLGSLTNTRGKLASGGTLLLRRSTAINNQAGQLISQSLMTLNTSGQLDNSNRGTVAANNTLTVVASGNVLNDADGLIYSQSANAHVQAASLSNVRGTVQSVGALRVDVVGDVNNQNGRIIAQGGDLNVSAANLYSQGGVLSSLQGLFTASVTGVLKNGYDANRQGGVIQAQRLNLTALSSFDNYGGRVSARTGEALINTASFDNRNGGLYAKGLVRVTGGNFDNSGDNDGQIAGGQVELNLSGALNNRFGIIESDSTLAVTAQSLDNQTGQLRALGGGGATNFQIGNLFDNRNGTLESANSDLILNAGSFLNGGGSLLHTGNGTFDISTANLTNAGGSIVTRGGLTLTADSWTNSSVIQAGRLTVNVGTLNQTAGGQLLASSLFSGSGSNWTNDGLIASDGSLSLNLGGTYGGNGRLSSVGTLGLSAAQVNLNAASTIAGGGDTSVSVGGQLSNVGRLTSATNLTVNAGSINNQGTLGSGQALTVTTGSLVNDRGLIFSGSNMSLRVSSLNNSYANIYSLGNLTIDRNGQGALADSIVNSSASIQSDGSMSLAASTIQNIRAILTTSNGGIYSAMIKEGACNREFYNNDCKTSTQTHTWDVTQREKLEVTAASAASGIAAGGSLSMNGGDLLNQSSTIATGGNFTATLNNLTNTGVEASDTETVTVYRSMRTSNASMWTKAAQDFTDKYWLGSSGYDASLTGLQAALADFVRITETDMPEFYKVTRLSNGDQSYAAVIQAAGAVNVNAQNDINNSVVRAGYTYVSGGSRTDTNAPGTQFSTRITVNQQLPPDLAQQQVNPLSLPGFSLPTGQNGLFRLSGQSGTAVAVAQPVGLPQSWTMGSAAVSVAQREQTVSDAQASTIQIGSVSQISNAARQLASVTRQSAGVSANASAFDTSAPGAAPIGGLVLPGHTSDSAGVTSVDSVTGIATGNQGSGVLLPVQNTGSTSGLPTITAISSGNSAAQNAGRVQGTQVSQAGQVVNGTQGSLVSAINQATTGVQSGTTATVTQVVVNAQGGQVIAPVRNPVATQGGPLVTSVGNPAVSQGVSVAAPVRNTVAAQGGPVTAAVLNPVVTQTNPVSATQNTSNQPATVAQASAITPVVSAAAQTVTRVEGLPSSSFVSRPQKYLIETNPVLTELKQFLSSDYLLAGLGYDPEVSAKRLGDGLYEQRLVQQAVVARTGQAFIDGQTSNEAQFKYLMNNAIASKQQLNLAVGVSLSSQQVAALTHDIVWLEEHEVNGEMVLVPVLYLAQADNRLGPTGALIAGNDVSLIAGQNLDNVGTLRAANNLSAAAGNDLVNSGLIEAGNRLDLLAGNDLINKAGGIIAGRDVTLTAIRGDVINERTVTSHQSAADDATWRKDFADSAARIEAANDMSLQAGRDVKNTGGVLQAGRDLSIAAGRDVAIDSAQTENGQTRGANSSNSSITQLGSTVSAGRDLTAQAGRDINVIASSIDAKRDIAMAATENLTLSSAADEQHSYGKSKKVTEQEDHVSQVSADLKAGGSVALQAGQNLAVISSRITAGKEAYLVAGENLDILAAQDSDYSLYDMKKKGSFGAKKTQRDEITDVKNIGSEITTGGDLLLSSGGDQKYQVAKLESGKDLTIESGGAVTFEGVKDLHQESHEKSKSDLAWNSSKGKGNTDETLRQSELVAKGEVAIRAVQGLKIDIKQIDQQSVSQTIDAMVKADPQLAWLKEAELRGDVDWRQVKEVHDSFKYDNSSLGQGAMLAIIIVVTVLTAGAGTFAAAGTAAGSAATGAATAAGVSATTAATIGTAANAAAVASLTSITAQGVVSTINNKGNLGAALKDTFSSDSLKSAAISGLTAGFTAGVIDPQLGGTTKPFNSLTKGFDLSTLGGAGGFALHAGAQGLASGAINTAVNGGSLGDNLVNGLVSQAGTVAAAIGFNQVGSFADQKFTEATLAGDVSGKAMWAEGGIGRTTLHALMGGAVSSATGGDFTTGAVAAGASQAMAGTLNEVFKNNPEYRQAAAQIVGLTAAGLAGGDVEKAAWVSAMADQYNRQLHPNEIPLLEKQSSSLAQEANISPAEAEKRLAQALAYYTDKDWNNALAAKGVVPDALTLKHLGIALSPLADSYAVVGDVPVVAGSKSYTPAETVALITEYRNTHTAEYADPSINNLNMQGAYAGDPKYQYADFYRKNLAVKTDFLSAVSGNLAGIAQGSGGALSDSLGSAWALMSDPVGVSEQAANGLMGLSKSPWGSFKNSVEASQTKEAMATIYDMQGNTAASAAIRAKSDLEFALNFLPANRAKTLAELGAGRKFAMDGPC

SEQ ID NO: 866 - protein, 236 aa, Picrophilus torridus, DSM 9790
  Pto VMA N-extein
MSGSIYSVSGPVVIAQDIENAKMFDVVRVGELGLIGEIIRISGNKATIQVYEDTSGLRPGEKVYSTGKPLSVELGPGLLSSIYDGIQRPLDVIRAKTGDFIAKGVNIPPLNEEKLWDFKPLVNEGQQVKSNFIIGEVDETEIIKNKIMVPYGVEGTVKSIKSGKFKVSDTVAIIETKNGDYEIKLKQIWPVREARRVFHKFPPEIPLITGQRVIDAFFPVAKGGTVAVPGPFGSGK

SEQ ID NO: 867 - protein, 361 aa, Porphyra yezoensis chloroplast, cultivar U-51
  Pye DnaB N-extein
MLTQQSISLLKSVEKISPDFFYFTSTSLLYRAALENVNHAKTKSVRNFFINLKNEKMIQDLNELNEVFSLIEQAPLSDTISEYSAVVIDNYIKRLLLACGDSLCLISCSKQLIEQKNITSIVSQLTKAYEILDEKDTQTLATILANLLVHLDTRKKISINSSILSGFTELDSITQGFKKSDLIILAGRPSMGKTAFAINITRYVINQKRSYVILFSLEMSTEQLLRRILAQECNLNGQKIQSGQLNNDEWQYVIQKSKTLANLNLYIDDSAKISTDTIKTKVKFFKLQGKNIELIIIDYLQLLQESRQSDNRSQELSLITRSLKILAKDLSLPILALSQLNRNLETRSDKRPLLSDLRESG

SEQ ID NO: 868 - protein, 265 aa, Roseovarius species 217
  Rsp Rir1 N-extein
MSRFAAPIAEQIWNMKYRFKTEDGGDASVEDSWRRIARALAVLEAEPEVWEDRFFHALEDFKFLPAGRITAGAGTARKVTLFNCFVMGTVPDDMGGIFDNLREAALTMQQGGGIGYDFSTIRPKGAEVKGVSADASGPLSFMDVWDAMCRTIMSAGSRRGAMMATMRCDHPDIEAFIAAKSDPARLRMFNLSVLITDAFMEAVKADGPWDLVFGGRVYHTVQARDLWNRIMQATYDYAEPGVIFIDRINAANNLSYCETIAATNP

SEQ ID NO: 869 - protein, 447 aa, Salmonella phage SETP12
  SaP-SETP12 dpol N-extein
MNLLYLDTETFSEADLKKVGSYAYAEHPTTEIVICTYAFDEGPVQVWDATDGSDMPRDLRRAMLKLQKPDSNLKLVGQNFLMFDRLVIKHCWGFELLVENIIDTMIVAFRHALPGSLASLCEVLNIDASMAKDKRGKALIQRFSKPTPKNYKIRRYTAATHPKEWAEFIAYAKSDITSMREVYKKMPKWGNSEFEDRVLWLDQVINDRGFKVDVALAEAAIEAVTRHKEELQEEAQRKYGGSLTGKDFLPILQELAPAHRIHNAQKSTLNDLLADEDLPDDARTIIEMRLGAASTASTKYAPLLLGRSSDDRRRGCLQYGGAKRTLRWAGKGFQPQNLARGYYHDDELDRGIAALLKGRAHRRFDVAKLTASTVRSCIIPEAGRKFVVADYSNVEGRGLAWLAGEETALDTFRAGLDIYCVTAGKMFGMDPDDIKKERKDLRQIGKA

SEQ ID NO: 870 - protein, 447 aa, Salmonella phage SETP3; identical to SEQ ID NO: 869
  SaP-SETP3 dpol N-extein

SEQ ID NO: 871 - protein, 33 aa, Salmonella phage SETP3
  SaP-SETP3 Helicase N-extein
MSKFTRRPYQKLMTSFMLRHPRCNIWASMGSGK

SEQ ID NO: 872 - protein, 447 aa, Salmonella phage SETP5; identical to SEQ ID NO: 869
  SaP-SETP5 dpol N-extein

SEQ ID NO: 873 - protein, 310 aa, Streptomyces avermitilis MA-4680
  Sav Helicase N-extein
MDLVPALEEPLKKVLGPATAKVMAEHLGLHTVGDLLHHYPRRYEERGQLTHLADLPMDEHVTVVAQVADARLHTFASAKAPRGKGQRLEVTITDGSGRLQLVFFGNGVHKPHKDLLPGTRAMFSGKVSVFNRRLQLAHPAYELLRGADDEAAESVDSWAGALIPIYPATAKLESWKIAKSVQTVLPSVQEALDPLPDSLRDGRGLISLPEALLKIHRPHTKADIEDARARLKWDEAFVLQVALARRRHADAQLPAAARKPKPDGLLTAFDAKLPFTLTEGQQKVSKEIFDDLATEHPMHRLLQGEVGSGK

SEQ ID NO: 874 - protein, 18 aa, Saccharomyces castellii, strain CBS4309
  Sca-CBS4309 VMA N-extein
ISQSLSKYSNSDSIIYVG

SEQ ID NO: 875 - protein, 18 aa, Saccharomyces cariocanus, strain="UFRJ 50791
  Scar VMA N-extein
ISQSLSKYSNSDAIIYVG

SEQ ID NO: 876 - protein, 283 aa, Saccharomyces cerevisiae (nucleus)
  Sce VMA N-extein
MAGAIENARKEIKRISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVG

SEQ ID NO: 877 - protein, 28 aa, Saccharomyces cerevisiae strain DH1-1A
  Sce-DH1-1A VMA N-extein
PGAFGCGKTVISQSLSKYSNSDAIIYVG

SEQ ID NO: 878 - protein, 258 aa, Saccharomyces cerevisiae OUT7091
  Sce-OUT7091 VMA N-extein
GAIYSVSGPVVIAENMIGCAMYELVKVGHANLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVG

SEQ ID NO: 879 - protein, 258 aa, Saccharomyces cerevisiae OUT7112
  Sce-OUT7112 VMA N-extein
GAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVG

SEQ ID NO: 880 - protein, 18 aa, Saccharomyces dairenensis, strain CBS 421
  Sda VMA N-extein
ISQSLSKYSNSDTIIYVG

SEQ ID NO: 881 - protein, 377 aa, Staphylococcus epidermidis RP62A
  Sep RIR1 N-extein
MSKWIEKNNEIMRRDELGQLSLSKDKEAIKLYLEHIKSKTKQFSNQIARLRYLVEEDYYIDVFKDYSEETLLELLDYAYSFGFEFQSFMAASKFYDTYALKTRDKSQWLEDFEQHNVIVSLYLAGGDVDLAKRYIKAHTLQTVQTATPTYLNAGRKQRGELASCYLFTMDDTLNSINFIRSQVSQASKIAGGVAVNLTRLRGRGATLKGVKNVGKGIVPVAKLIEGEVSYADQLGQRAGAGAAYLNIFHSDVIELLNTKKVNADEDTRLATLSIGLIVPSLFFDLAKEDKDLYMFEPYSIQEEFGKDVILDDININDWYDKFVENENVIKHKINAREMLNLIAQIQLQSGYPYIMYKDNANKNHALNELGEIKMSNL

SEQ ID NO: 882 - protein, 267 aa, Saccharomyces exiguus, strain="IFO1128"
  Sex-IFO1128 VMA N-extein
LEDHDESEYGSIYSVSGPVIVAENMIGCAMYELVKVGHDNLVGEVIRIDGDKATIQVYEETAGATVGDPVLRTGKPLSVELGPGLMETIYDGIQRPLKTIKDISQSIYIPRGIDAPALSRDIKWNFTPGKYVVGDHISGGDIFGSIFENSLLDNHKILLPPRARGTITWIAPAGEYTVDEKVLEVEFDGVKSDYSMYHTWPVRVPRPVAEKLSADYPLLTGQRVLDALFPCVQGGTTCIPGAFGCGKTVISQSLSKYSNSDAIIYVG

SEQ ID NO: 883 - protein, 578 aa, Stigeoclonium helveticum, strain UTEX 441
  She RPB2 (RpoB) N-extein
MSTSQSLNIIPIEYSLQTYQRSNQDTSMLHRPVVKEGEWVQAGDLLSDCASSIGGEFSIGQNILIAYLPWEGYNYEDAILISERLVYDDLYTSIHIERYDISTEKNPYGIEKITKDIVLLKDTTELNHLDKNGIAQLGAWLKEGDILVGKITPTESKKEVARYVQLYNDILGKKINYAIRDSSLRVPRGLEAKVIRVKTFPERKNETKNWENKIGLKSKALAFSVQHFLSKNQSNKKRTLSLKSKWEKETSLSSFSSLAWQKKSPLFFVFKNGIFEKLKNFPKKKKKNERVFALKKKSSKKFRFFELQKKFRFFFRNFFFFKAPKKKSPLFFFFKSETFDKERNFQKMSPNQSKQNWVKISIKKEWQKVGSFGKKKASKGKISFFPSFPQASLVGKASFFSPSRFEKKRDASNFLKSSCISSVHIYLAEKRKVQVGDKMAGRHGNKGIISQILPRQDMPYLPDGTPIDMALNPLGVPSRMNVGQIYECLLGLAGKHLGEQYRIQPFDEAFGPEASRSFVFSKLYSAKTKTGQSWLFQPTNPGKLKLFDGRTGNCFDQAITTGYSYMIKLVHLVDEKIH

SEQ ID NO: 884 - protein, 371 aa, Shigella flexneri 5 str. 8401
  ShP-Sfv-5 Primase N-extein
MRPSELSDLLWAQVDRVAPHLLPNGKIEGHEWVAGNVNGDKGNSLKVNLIGKKKWADFAEGDGGDMLDLWMACRGINLHQAMQEAKAFLGIKDDDHHFDARREKKFSRPDRKKIARYVTRTESHLEYLQSRGISPEVVKRYEVVSGKVWNGERELDALVLPYKRDGELLQVKRISTERPDGKKVIMAEGDCEPCLFGWQALDAGVRAVVLCEGEIDCMSYAQYGISALSVPFGGGKGAKQQWIEFEYHNLDRFEEIFISMDVDDVGREAAREIVSRLGEHRCRLVTLPYKDINECLMNGVTEDEIWQYIGTASYFDPEELYSAREFYQDTINAFYGKQQYLFNPPWESLADKFQFREAELTLVNGVNGHGK

SEQ ID NO: 885 - protein, 377 aa, Staphylothermus marinus F1
  Smar 1471 N-extein
MFSRRERKERLTKLPGEEEVSEAVKSIIVPAEPIQVAKRDPSWRIIESYYVYKPFVKIVIAETPQGPMYFVEEYGLTPSDKEVLEKLTDILMDEIRPPTRPEDIKDLKGYVFKETERIADKYREKLGLVGARKIKLLYYIERNLLGYGPIDPLMKDPNIEDISCNGVNIPIYVWHKKYESIPTNITFIDEDYLNEFVMKMAHMAGKHISIAFPILDAMLPEKHRLAATFGREVSVKGPTFTIRKFRERPFSVTEIIQSGVINSLVAAYLWTLIEHGKTAMIAGGTGVGKTTMLNVISMFIRPGMKIVTIEDTPEINLPHPNWVQLTSRETYLVGTSSLGTNIRLFDLVKLSLRYRPDYIIVGEVRGEEAFVLFQAMA

SEQ ID NO: 886 - protein, 429 aa, Staphylothermus marinus F1
  Smar MCM2 N-extein
MTYTLEKEKTEPDLVTRFKRFLWDFRDRRTGMFKYRERISHMALMGQRSLLIDFNDITLFDRGLAHIIENNPDTAIEAASIAIKELMRRENPEYAESVDKFYPRFRNPSKVLRIRELTSEYIGKFVAVEGILTRLTRVEARLVKAVFKHAECGAEFEWPEEGEMGERIEKPSYCPICGKTGKFQLLLNKSRFIDWQKIVVQEKPEEIPPGQIPRSIEVVLTGDLVDSARPGDRVLVTGILRVMPTSSVQRGIGKSVFGFYLEANYVDVQQKVLEEIEITREDEDKIKELARDPWIREKIIASIAPAIYGHWNIKEAIALLLFGGVPKLLPDGTRIRGDIHILLVGDPGTAKSQMLQYTAKIAPRGIYTSGKGSTAAGLTASVLRDKATGEYYLEAGALVLADGGVACIDEIDKMREEDRSAIHEALEQQ

SEQ ID NO: 887 - protein, 269 aa, Saccharomyces pastorianus IFO11023
  Spa VMA N-extein
ISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPGRVPRPVTEKLSADYPLLTGQRVLDALFPCVQGGTTCIPGAFGCGKTVISQSLSKYSNSDAIIYVG

SEQ ID NO: 888 - protein, 129 aa, Spirulina platensis, strain C1
  Spl DnaX N-extein
MTYEPLHHKYRPQTFADLVGQEAIAQTLTNAIRSRRIAPAYLFTGPRGTGKTSSARILAKSLNCLQTSNPTETPCGICEVCRGITTGATLDFVEIDAASNTGVDHIRDLIERTQFSPVQCRYKVYVIDE

SEQ ID NO: 889 - protein, 230 aa, Salinibacter ruber DSM 13855
  Sru DnaB N-extein
MRGGTGEQQREQAQAVHEQSGRVPPQAVDVEKSVLGAMLIEREAIPQAIEILPSDAFYESKHQSIYGCIQDLFERGNPVDLVTLTEELRRRDKLEEIGGAYYLTELTTQVASAANVEYHARIIAEKSLLRRMIETMTTVVQKAYDPGADAFELLDEAESKIFQISDNQLRKAAAPMNEVVKDTLERLETIHGQDGGITGVPSGFPKLDDLTSGWQDSDLIIIAARPSMGK

SEQ ID NO: 890 - protein, 498 aa, Salinibacter ruber DSM 13855
  Sru PolBc N-extein
MSSPPAVNTPAPADATQSAADTALFGKDPMPRLVDVHPMMDRPSNEPARVRVYQRSEDFASIHEQEDTFFPFFFLSDFSLLADRYRNGDVHTATPLNGDNFYQYLLTFETWSDYWDALRQVEHRSDSDQQAPDELYRVGSPAQQYLMQTGRSCLLGMTLDDLHRLQLDIEVYSEGSFPNADRPDDKVIIVALSDNRGWDEVLHLRDGIGEEQLLQELVYVLQERDPDVIEGHNIFEFDLAYLLDRCALHGVDFAIGRDGSVPRTYDSSMRFAERTVDYPAVDIVGRHVIDTYFQVMSFDVFSRDLPDYSLKTAARYFDLAPEERTYIEGTEIAKAWRTDRATLLEYALDDVIETKRLAGHLSGSTFYLAQMLPMTYGSSARRGPAGKIESLFVREYLRRRHALPRSEWGSQSMGGYTDIFITGVLGPIVYADVESLYPSIMLNYDVQPSGDTLDLFPQLLERLTDLRLKTKQDMKDAEEEEVRSELDARQSSYKVLIN

SEQ ID NO: 891 - protein, 129 aa, Synechocystis species, strain PCC6803
  Ssp DnaX N-extein
MAYEPLHHKYRPQTFADLVGQTAIAATLSNAIEQERIVPAYLFTGPRGTGKTSSARILAKSLNCIAGDRPTATPCGQCATCRAITNGSALDVIEIDAASNTGVDNIREIIERAQFAPVQCRYKVYVIDE

SEQ ID NO: 892 - protein, 436 aa, Synechocystis species, strain PCC6803
  Ssp GyrB N-extein
MTMTTTNYGADQIQVLEGLEPVRKRPGMYIGSTGPKGLHHLVYEVVDNAIDEALAGYCTHIEIDINADGSVTVVDNGRGIPTDIHPTTGRSALETVLTVLHAGGKFGGGGYKVSGGLHGVGVSVVNALSEWVEVKVWRQGKEHFQRFERGNPIGTLEATPNEGHSTGTQVSFLPDTQIFKDGIEFDYHTLASRLKELAYLNAGVRITFGDRRADSLKEEQFYYEGGIREYVTYMTTDKTPLHEEIIYTSGEKNDVQVEVALQWCVDAYSDTLLGFANNIRTIDGGTHLEGLKAVLTRTLNSVARKRNKLKDGDSNLGGENIREGLTGVISVKVPDPEFEGQTKTKLGNTEVRGIVDTLVGEALTEFLEFNPGVADAIIEKAVQAFKAAEAARRARELVRRKSVLESSTLPGKLADCSSKDPSESEIFIVEGDSAGG

SEQ ID NO: 893 - protein, 388 aa, Synechococcus species JA-2-3B'a(2-13)
  Ssp-JA2 DnaB N-extein
MISDYDLTGGDRLPPQNIEAEEEILGGILLDPDALVRVAEFLRPEMFYISAHQEIYRAALQLHSQGQPTDLMTVSAWLADHHLLERVGGTGAIRRLLEQTVSSVNIDQYARLVMDKYMRRQLIQVSNTLARLAYDTSQPLSQVMDQAEQQVFGLTQERVQRSLIPASEVLVNIFSDLEEKFQSGAQLPGIPTKFIDLDNLTQGLQRSDLLILAGRPSMGKTSLALNIAQNVAAYAKQPVAIFSLEMSREQLVQRLLASEARIDSSRLRSGRISEHEWQRLGQAIGFLSQLPLFIDDTPDCTVTEIRSKARRLQAEQGGTLGMVLIDYLQLMQGSAADNRVQELSRITRGLKAMAKELMVPVLVLSQLSRAVESRSDKRPQLADLRESG

SEQ ID NO: 894 - protein, 410 aa, Synechococcus species JA-2-3B'a(2-13)
  Ssp-JA2 RIR1 N-extein
MQGLDPAETTGSLPLGEFPATAPAASPVFYRTYSRRRPDGSRETWSEVCDRTLADIARLGRFTPQERQLVERLQRQLKALISGRALWVMGTDWIQKPENFSGAYNCTSLAVVDWRAFGLMMDLAMMGCGTGAVLEPQFIRQLPPIVNRLRVHVKGSIGATPPEERQEHTRIHRQGSQVHIQVGDSRRGWVESYQALLELASDPSFGGQVEVTVDLSDVRPAGERLKGFGGVANPIKLPGLYERCAAILNRAVGRQLNSVECCLLIDEAAVVVVAGNIRRSAGIRQFAADDQLGSTAKDNLWQQDENGNWRIDPERDALRMANHTRVFHRKPTREECVEAVRKQFYSGEGAIQWAGEAVARANCDLIPPDLKPDFLKAYEAGTAREWLKGRDPSLGEEELQDRLWRYGLNP

SEQ ID NO: 895 - protein, 388 aa, Synechococcus species JA-3-3Ab
  Ssp-JA3 DnaB N-extein
MISDYDLTGGDRLPPQNIEAEEEILGGILLDPEAMARVAELLRPEMFYLSAHQEIYRAALQLYSQGQPTDLTTVSAWLADHQLLERVGGTAAIRRLVEQTVSSVNIDQYARLVVDKYMRRRLIQVSNTLARLAYDTSQPLPQLLDRAEQEVFSLTQERVQRSLVPASEVLVNIFSELEERFQSGAQIPGIPTKFIDLDNLTQGLQRSDLVILAGRPSMGKTSLALNIAQNVAAYVKQPVAIFSLEMSREQLVQRLLASEARIDSSRLRSGRISENEWQRLGQAIGFLSQLPLFIDDTPNCTVTEIRSKARRLQVEQGGTLGLVLIDYLQLIQGSESDNRVQELSRITRGLKALAKELMVPVLVLSQLSRAVESRSDKRPQLADLRESG

SEQ ID NO: 896 - protein, 423 aa, Synechococcus species JA-3-3Ab
  Ssp-JA3 RIR1 N-extein
MVQSKEAHSPAIQGLGMGSLGEFPATAPAAAPVFYRTYSRRRPDSSRETWSDVCDRTLADIARLGRFTPQERELVERLQRQLKALISGRALWVMGTDWIQKPENYSGAYNCTSLTVVDWRSFGLMMDLAMMGCGTGAVLEPQFINRLPPILNRLQVQVVGSIGATPRHSRQEHTPIQRQGSRVHIQVGDSRRGWVESYQALLELAADPSFGGQVEVTVDLSHVRPAGERLKGFGGVANPIKLPGLYQRCAAILNKAVGRQLNSVECCLLIDEAAATVVAGNIRRSAGMRQFAADDELGSSAKDNLWQQDEQGNWRIDPERDALRMANHTRVFHRKPTREECIAAVRKQFYSGEGAIQWAGEAVARANADLINTPELKREFLNVYASEGPEGARRWIEERQAASSSPSVQPPTWHRVQRYGLNP

SEQ ID NO: 897 - protein, 147 aa, Staphylococcus phage Twort
  StP-Twort ORF6 N-extein
MKLRIKNLFTYVEFEEDDKYLKDIFLKRVHKTIGARQQGFQFSPAYKRGSWDGYIDFYVYEEDKFPTGLLHRVELLLGELQSRYNFQYSKIDERSESFLAPEDIDKEIKLLDNKIGQITLREYQYQAVYESLVNFNGVLKIATNGGK

SEQ ID NO: 898 - protein, 18 aa, Saccharomyces unisporus, strain CBS 398
  Sun VMA N-extein
ISQSLSKYSNSDTIIYVG

SEQ ID NO: 899 - protein, 235 aa, Thermoplasma acidophilum, ATCC 25905
  Tac-ATCC25905 VMA N-extein
MGKIIRISGPVVVAEDVEDAKMYDVVKVGEMGLIGEIIKIEGNRSTIQVYEDTAGIRPDEKVENTRRPLSVELGPGILKSIYDGIQRPLDVIKITSGDFIARGLNPPALDRQKKWEFVPAVKKGETVFPGQILGTVQETSLITHRIMVPEGISGKVTMIADGEHRVEDVIATVSGNGKSYDIQMMTTWPVRKARRVQRKLLSRDPLVTAQSGNRCAFPVAEAANCRVPGPFGSGK

SEQ ID NO: 900 - protein, 235 aa, Thermoplasma acidophilum, DSM1728
  Tac-DSM1728 VMA N-extein
MGKIIRISGPVVVAEDVEDAKMYDVVKVGEMGLIGEIIKIEGNRSTIQVYEDTAGIRPDEKVENTRRPLSVELGPGILKSIYDGIQRPLDVIKITSGDFIARGLNPPALDRQKKWEFVPAVKKGETVFPGQILGTVQETSLITHRIMVPEGISGKVTMIADGEHRVEDVIATVSGNGKSYDIQMMTTWPVRKARRVQRKLPPEIPLVTGQRVIDALFPVAKGGTAAVPGPFGSGK

SEQ ID NO: 901 - protein, 409 aa, Thermococcus aggregans
  Tag Pol-1 (Tsp-TY Pol-1) N-extein
MILDTDYITKDGKPIIRIFKKENGEFKIELDPHFQPYIYALLKDDSAIDEIKAIKGERHGKIVRVVDAVKVKKKFLGRDVEVWKLIFEHPQDVPALRGKIREHPAVIDIYEYDIPFAKRYLIDKGLIPMEGDEELKLMAFDIETFYHEGDEFGKGEIIMISYADEEEARVITWKNIDLPYVDVVSNEREMIKRFVQIVREKDPDVLITYNGDNFDLPYLIKRAEKLGVTLLLGRDKEHPEPKIHRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYRRRLRTTYLGGYVKEPERGLWENIAYLDFR

SEQ ID NO: 902 - protein, 854 aa, Thermococcus aggregans
  Tag Pol-2 (Tsp-TY Pol-2) N-extein
MILDTDYITKDGKPIIRIFKKENGEFKIELDPHFQPYIYALLKDDSAIDEIKAIKGERHGKIVRVVDAVKVKKKFLGRDVEVWKLIFEHPQDVPALRGKIREHPAVIDIYEYDIPFAKRYLIDKGLIPMEGDEELKLMAFDIETFYHEGDEFGKGEIIMISYADEEEARVITWKNIDLPYVDVVSNEREMIKRFVQIVREKDPDVLITYNGDNFDLPYLIKRAEKLGVTLLLGRDKEHPEPKIHRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYRRRLRTTYLGGYVKEPERGLWENIAYLDFRCHPADTKVIVKGKGIVNISDVKEGDYILGIDGWQRVKKVWKYHYEGKLININGLKCTPNHKVPVVTENDRQTRIRDSLAKSFLSGKVKGKIITTKLFEKIAEFEKNKPSEEEILKGELSGIILAEGTLLRKDIEYFDSSRGKKRISHQYRVEITIGENEKELLERILYIFDKLFGIRPSVKKKGDTNALKITTAKKAVYLQIEELLKNIESLYAPAVLRGFFERDATVNKIRSTIVVTQGTNNKWKIDIVAKLLDSLGIPYSRYEYKYIENGKELTKHILEITGRDGLILFQTLVGFISSEKNEALEKAIEVREMNRLKNNSFYNLSTFEVSSEYYKGEVYDLTLEGNPYYFANGILTHNSLYPSIIVTHNVSPDTLEREGCKNYDVAPIVGYKFCKDFPGFIPSILGELITMRQEIKKKMKATIDPIEKKMLDYRQRAVKLLAN

SEQ ID NO: 903 - protein, 212 aa, Trichodesmium erythraeum IMS101
  Ter DnaB-1 N-extein
MQSDRLPPQNIESEEAILGGILLDPEAINRVTELLHPEFFAIQAHQIIYKAMCQLYSQGKPTDLMTVTSWLSDHNQLEKIGGRVKIVQLLERTVSAVNIDQYAALVLDKYIRRKLIQAGNEIFDLGFQTATKLEIILDQAEQKIFALTQDKPQQDLVPISETLINTFQEIEDRNEGVALPGLPCGFYDLDAMTGGFQRSDLIIVAGRPSMGK

SEQ ID NO: 904 - protein, 719 aa, Trichodesmium erythraeum IMS101
  Ter DnaE-1 N-extein
MSFVGLHIHSDYSLLDGASQLPQLIDRAVELGMPAIALTDHGVMYGAIQLIKLCRNKNIKPIIGNEMYVIKGDIEKQQRGKKFHQVVLAKNTQGYKNLVKLTTLSHLHGFQGKGIFARPCINKELLEKYHEGLIVTSGCLAGEVPQNIMRGELEEAKKIAKWYKDLFGEDYYLEIQDHGFQEDRVVNTGIVTIAKKLKIKIVATNDSHFISCRDVEAHDALLCINTQKLIAEEKRMRYSGTEYLKSAEEMKQLFRDHLENEVIEEAIANTLEVANKVKAYEGILGEPRIPDYPIPPDHNADTYLEKLAWSGLLERLKLKQKSEISPIYKERMETELKVLQDKGFSTYFLVVWDYIKYARDNNIPVGPGRGSAAGSLVAYSLRITNIDPVHHGLLFERFLNPERKSMPDIDTDFCIENRDVMIKYVTQRYGEERVAQIITFNRMTSKAVLKDVGRVLGISFGEANKMAKLIPVARGKPAKLKVMISDETPSPEFKKAYDNQETPIEDNKAGKISTISVRQWIDMAIRIEGTNKTFGVHAAGVVISKEPLDEIVPLQRNNDGSVITQYHMEDIESLGLLKMDFLGLKNLTIIQNTAELIKKNHHLPLVPDDLPANERKAIEILAKGNTKKMPEDVKKTYDLIKSGDLEGVFQLESSGMVDVVKKLKPTSIEDISSILALYRPGPLDAGLIPKFIDRKHGSEKIEYQHPKLEPILKETYGVL

SEQ ID NO: 905 - protein, 439 aa, Trichodesmium erythraeum IMS101
  Ter GyrB N-extein
MASNNYGAEQIQVLEGLEAVRKRPGMYIGTTGPRGLHHLVYEVVDNSIDEALAGYCTHIEVDLNKDGSVKVTDDGRGIPVDTHSKTGKSALETVMTVLHAGGKFGGGGYKVSGGLHGVGVSVVNALSEWVEVTVWRDKKTHIQGYERGQPTGDLKSKPNKEKRTGTSVQFLPDQEIFTTGIQFDYNTIIGRLRELAYLNAGVKITITDNRLELVKSDEPKVESYCYEGGIKEYVTYMNREKQSLHEEVIFVRGEKNDVQVEVALQWCIDAFSDNVLGFANNIRTIDGGTHLEGLKTVLTRTMNGIARKRNKLKDSDPNLGGENVREGLTAVISVKVPEPEFEGQTKTKLGNTEVRGIVDSLVGEVLSEYLDFNPQVADAVLDKAIQAFKAAEAARRARDLVRRKSVLESSPLPGKLADCSTKNPEESEIYLVEGDSASG

SEQ ID NO: 906 - protein, 141 aa, Trichodesmium erythraeum IMS101
  Ter Ndse-1 N-extein
MRILVTGGAGFLGSHLIDRLIEQGHEVLCLDNFYTGNKHNIYNWLNNPSFELIRHDITEPIRLEVDQIYHLACPASPIHYQYNPVKTIKTNVMGTLNMLGLAKRVKAKFFLASTSEVYGDPDVHPQTEEYRGNVNCIGIRS

SEQ ID NO: 907 - protein, 508 aa, Trichodesmium erythraeum IMS101
  Ter Ndse-2 N-extein
MRILVTGGAGFLGSHLIDRLIEQGHEVLCLDNFYTGNKHNIYNWLNNPSFELIRHDITEPIRLEVDQIYHLACPASPIHYQYNPVKTIKTNVMGTLNMLGLAKRVKAKFFLASTSEVYGDPDVHPQTEEYRGNVNCIGIRSCFDSKTEILTEAGWVAFPNLQSEVKVATLNSEGKVEYHIPEEYIVQSYIGEMYRFANTNFDFCVTPNHWMYVRNKTGNLEFIRADEAKLWQSLEVLTGGDFEGEKEEWLELRKSPINSHRKVEKIFMDDWLEFLGYYISEGRVDVKKSLRVVGGNDAYVADYNILIGQENSELALKIASCLRRLGFNFSEILFDSDKHQFRVCSKQLAEMLLPLGKSGEKYIPRELLKLSKRQLLILFKALIMGDNSEQKNHYTYYSKSKRLADDIQELALRCGYAATVVSHAVGRDLYQVNIRPAEDANLVVPERFHYVGKVYCVNVTNHVVFVRRNGRAAWCGQCYDEGKRVAETLAFDYHRQNNVDIRVARIFN

SEQ ID NO: 908 - protein, 610 aa, Trichodesmium erythraeum IMS101
  Ter Snf2 N-extein
MAILHSFWVTEHEQPSFLFIWGEAWHRVTEEDAGEVEKITNNPYSITLDELLKLSEANIYLSLEKHKKSTNQTLGIPTKLSESNQKLYPIHSAISLSEIPENLYIYPWKIEGICLEPDEAIKFLQSIPLGQTTESFIGSDLKFWSHLARWSLDLLARCKFLPSIEQRSITQEFITTWQPLIDSSIDQTRLKNFAQQMPLVCRTYNLDWQLHPSLESLQIITKNNSYSNLPRLQSSQEIIQDFLKNTIDKQIRQLSAEISLTETTSLNSSIRQWLKSLSGKLSLKLPAPQETKKIQKILDNWKSPLQEYQAIENKFVACFCLHSPSNNSQQWKLEYCLQGLDNPDFLVDAKTIWENPVASLNYQGKTIKLPQETLLKGLGLASRIYPIIEPSLQEATPQYCLLTSQQAYDFIKSGSGRFIDSGLGVILPPSLANREGWASRLGLSIQATAPKMKKTEKLGLKSLLNFKWQLSIGGHKLTKAEFEKLVSQDSPLVEVNGEWVELQGQDVRAAKNFFASRKDQMSLSLEDALRLATGDTQTVEKLPVVNFEAGGQFQELLDTLTNNRSLEEVSTPENFRGELRNYQARGVSWLSFLERWGLGACLADDMGLGK

SEQ ID NO: 909 - protein, 11 aa, Trichodesmium erythraeum IMS101
  Ter ThyX N-extein
MQQARTHRIGC

SEQ ID NO: 910 - protein, 406 aa, Thermococcus fumicolans
  Tfu Pol-1 N-extein
MILDTDYITEDGRPVIRVFKKENGEFKIEYDRDFEPYIYALLKDDSAIEDVKKITASRHGTTVRVVRAGKVKKKFLGRPIEVWKLYFTHPQDVPAIRDKIREHPAVVDIYEYDIPFAKRYLIDKGLIPMEGDEELKMLAFDIETLYHEGEEFAEGPILMISYADEEGARVITWKKIDLPYVDVVSTEKEMIKRFLKVVKEKDPDVLITYNGDNFDFAYLKKRSEKLGVKFILGRDGSEPKIQRMGDRFAVEVKGRIHFDLYPVIRHTINLPTYTLEAVYEAIFGQPKEKVYAEEIAQAWETGEGLERVARYSMEDAKVTYELGREFFPMEAQLSRLVGQSFWDVSRSSTGNLVEWYLLRKAYERNELAPNKPSGRELERRRGGYAGGYVKEPERGLWENIAYLDFR

SEQ ID NO: 911 - protein, 900 aa, Thermococcus fumicolans
  Tfu Pol-2 N-extein
MILDTDYITEDGRPVIRVFKKENGEFKIEYDRDFEPYIYALLKDDSAIEDVKKITASRHGTTVRVVRAGKVKKKFLGRPIEVWKLYFTHPQDVPAIRDKIREHPAVVDIYEYDIPFAKRYLIDKGLIPMEGDEELKMLAFDIETLYHEGEEFAEGPILMISYADEEGARVITWKKIDLPYVDVVSTEKEMIKRFLKVVKEKDPDVLITYNGDNFDFAYLKKRSEKLGVKFILGRDGSEPKIQRMGDRFAVEVKGRIHFDLYPVIRHTINLPTYTLEAVYEAIFGQPKEKVYAEEIAQAWETGEGLERVARYSMEDAKVTYELGREFFPMEAQLSRLVGQSFWDVSRSSTGNLVEWYLLRKAYERNELAPNKPSGRELERRRGGYAGGYVKEPERGLWENIAYLDFRCHPADTKVIVKGKGVVNISEVREGDYVLGIDGWQKVQRVWEYDYEGELVNINGLKCTPNHKLPVVRRTERQTAIRDSLAKSFLTKKVKGKLITTPLFEKIGKIEREDVPEEEILKGELAGIILAEGTLLRKDVEYFDSSRGKKRVSHQYRVEITVGAQEEDFQRRIVYIFERLFGVTPSVYRKKNTNAITFKVAKKEVYLRVREIMDGIENLHAPSVLRGFFEGDGSVNKVRKTVVVNQGTNNEWKIEVVSKLLNKLGIPHRRYTYDYTEREKTMTTHILEIAGRDGLILFQTIVGFISTEKNMALEEAIRNREVNRLENNAFYTLADFTAKTEYYKGKVYDLTLEGTPYYFANGILTHNSLYPSIIISHNVSPDTLNREGCGEYDEAPQVGHRFCKDFPGFIPSLLGDLLDERQKVKKHMKATVDPIEKKLLDYRQRAIKILANSFYGYYGYAKARWYCKECAESVTAWGRQYIETTMREIEEKFGFKVLYAD

SEQ ID NO: 912 - protein, 71 aa, Thermobifida fusca YX
  Tfus Hyp-2914 N-extein
MPKPERFVSRSDLGWGPSNASYANPKLGLVIHYDGSNQNLAAKDHSACINYWKNTRSFHTGPARGWADIGY

SEQ ID NO: 913 - protein, 95 aa, Thermobifida fusca YX
  Tfus RecA-1 N-extein
MSLARRSVTPIMKKKASTQQGFPVAASDRDKALETALAQIERQFGKGTIMRLGDDNRPPIESIPTGSISLDVALGIGGIPRGRIVEIYGPESSGK

SEQ ID NO: 914 - protein, 649 aa, Thermobifida fusca YX
  Tfus RecA-2 N-extein
MSLARRSVTPIMKKKASTQQGFPVAASDRDKALETALAQIERQFGKGTIMRLGDDNRPPIESIPTGSISLDVALGIGGIPRGRIVEIYGPESSGKCLTADTYVWTDRGLETVAEVFGRAGLPLSSTSRVTDVRDRDIRVVNEKGELEQVAALTHNGRQPVVRITVASGRQVTVTRNHPLRVMNDDGFIVWREAGQLREGDVLVSAAFGAVQAASGGGLSEDEAVLLGYLTAAGSLDPAGHVCFTTTDIETGAEFAALAEWLLDTTVTAVPGDGQVAYVLSDPAARHTLAERYGVDYAAAARIPQCVRTAGDKMQRAFLAALYTAAGWTDTSAAVGLRTASAPLAREVQYLLYGLGIPADLDRSHGNGQHPWAVTISPAAAPRFHTEVGFRTAQQSPQTGLHEPTPQVEAIPNLTGLIHALRDSIGDRAESTDDPFPAASGGAYDRDQVRRVIDWAKRRTDEAPATANAILGYLTQLTDARYTYEPITAVEDAGQQPTFDLMVPRTHSFLANGILSHNTTVALHAVANAQRAGGIAAFIDAEHALDPSYAEKIGVNIDDLLLSQPDTGEQALEIVDMLVRSGAISIIVIDSVAALVPRAEIEGEMGDSHVGLQARLMSQALRKIAGALNQTKTTAIFINQLREKVGVMFG

SEQ ID NO: 915 - protein, 18 aa, Torulaspora globosa, strain CBS 764
  Tgl VMA N-extein
ISQSLSKYSNSDVIIYVG

SEQ ID NO: 916 - protein, 458 aa, Thermococcus hydrothermalis
  Thy Pol-1 N-extein
FEPYIYALLKDDSAIEEVKKITAGRHGRVVKVKRAEKVKKKFLGRPIEVWKLYFTHPQDVPAIRDEIRRHSAVVDIYEYDIPFAKRYLIDKGLIPMEGDEELKMMSFDIETLYHEGEEFGTGPILMISYADEGEARVITWKKIDLPYVEVVSTEKEMIKRFLKVVKEKDPDVLITYNGDNFDFAYLKKRCEKIGIKFTLRRDGSEPKIQRMGDRFAVEVKGRIHFDLYPVIRRTINLPTYTLEAVYEAVFGTPKEKVYPEEITTAWETGEGLERVARYSMEDAKVTYELGREFFPMEAQLSRLIGQSLWDVSRSSTGNLVEWFLLRKAYERNEIAPNKPDERELARRRGGYAGGYVKEPERGLWDNIVYLDFMSLYPSIIITHNVSPDTFNREGCKEYDTAPQVGHKFCKDVQGFIPSLLGALLDERQKIKKRMKASIDPLEKKLLDYRQKAIKILAN

SEQ ID NO: 917 - protein, 1044 aa, Thermococcus hydrothermalis
  Thy Pol-2 N-extein
FEPYIYALLKDDSAIEEVKKITAGRHGRVVKVKRAEKVKKKFLGRPIEVWKLYFTHPQDVPAIRDEIRRHSAVVDIYEYDIPFAKRYLIDKGLIPMEGDEELKMMSFDIETLYHEGEEFGTGPILMISYADEGEARVITWKKIDLPYVEVVSTEKEMIKRFLKVVKEKDPDVLITYNGDNFDFAYLKKRCEKIGIKFTLRRDGSEPKIQRMGDRFAVEVKGRIHFDLYPVIRRTINLPTYTLEAVYEAVFGTPKEKVYPEEITTAWETGEGLERVARYSMEDAKVTYELGREFFPMEAQLSRLIGQSLWDVSRSSTGNLVEWFLLRKAYERNEIAPNKPDERELARRRGGYAGGYVKEPERGLWDNIVYLDFMSLYPSIIITHNVSPDTFNREGCKEYDTAPQVGHKFCKDVQGFIPSLLGALLDERQKIKKRMKASIDPLEKKLLDYRQKAIKILANSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRSVSYEKFRELVKSEKLDGEKAKRIEWLLNGDVVLDKVLEVKKRPYEGYVYDLSVEEDENFLAGFGLLYAHNSYYGYYGYARARWYCKECAESVTAWGRDYIETTIHEIEERFGFKVLYAD

SEQ ID NO: 918 - protein, 362 aa, Thermococcus kodakaraensis KOD1
  Tko CDC21-1 N-extein
MDREEMIARFAKFLREYVDDEGNEVYINRLKDLLTVTPKRSLAIDWAHLNSFDPELADELLNNPEEAIASAEDAIQIVLREPPLLVEREFKVHARFYNLPKTLLVKELGSEHINKLIQVEGIITRVSEVKPFVEKAVFVCRDCGNEMVRLQRPYENLVKPAKCDACGSRNIELDVDKSRFLNFQSFRLQDRPESLKGGQMPRFVDAILLDDLVDAALPGDRVLVTGVLRVILEQREKRPIFKKILEVNHIEQLSKEIEELEISPEDEQKIRELAKRKDIVDAIVDSIAPAIWGHRIVKKGIALALFGGVQRTLPDGTKLRGESHVLLVGDPGVAKSQLLRYVANLAPRAIYTSGKSSSAAGL

SEQ ID NO: 919 - protein, 553 aa, Thermococcus kodakaraensis KOD1
  Tko CDC21-2 N-extein
MDREEMIARFAKFLREYVDDEGNEVYINRLKDLLTVTPKRSLAIDWAHLNSFDPELADELLNNPEEAIASAEDAIQIVLREPPLLVEREFKVHARFYNLPKTLLVKELGSEHINKLIQVEGIITRVSEVKPFVEKAVFVCRDCGNEMVRLQRPYENLVKPAKCDACGSRNIELDVDKSRFLNFQSFRLQDRPESLKGGQMPRFVDAILLDDLVDAALPGDRVLVTGVLRVILEQREKRPIFKKILEVNHIEQLSKEIEELEISPEDEQKIRELAKRKDIVDAIVDSIAPAIWGHRIVKKGIALALFGGVQRTLPDGTKLRGESHVLLVGDPGVAKSQLLRYVANLAPRAIYTSGKSSSAAGLCVAPDSIIKTNLGQFKIGELVEKAIPEKVQDYKSVNAEKLGLYIKTLDGDMRVLRLWKLRAPEKLIRIEGDGLSITVTPETKLLTPNGWVEARNVDGEVVTENGPVKVSKQEIESPHDYVYDLTVEGSHSFIANGFVVHNTAAAVRDEFTGSWVLEAGVLVLADGGFALIDEFDKMSDRDRSAIHEALEQQ

SEQ ID NO: 920 - protein, 20 aa, Thermococcus kodakaraensis KOD1
  Tko IF2 N-extein
MTKRIRQPIIAVLGHVDHGK

SEQ ID NO: 921 - protein, 511 aa, Thermococcus kodakaraensis KOD1
  Tko KlbA N-extein
MFQDEKKKKESLSWIDEILSGEEDPLAGILKKDDKKEQPSKNKVSEELPVPSSGVGSLEDILSGSTSEKRESRPTSETGADLLSQLLGGEEKPQKSMKEKTAEREKREPLPQSKPEPASTIPSATGATGADFLSELLGGSSGSATSQPVQTSPSKPVSNARSIFSESLREESSYAGRAQVLDAYGNVRILKVKGEPVPIYEIRLPKLSREEEQLFRRIKDRAITEIQIDPTAIPDPEERRKVFMNAVKRMIKEEAPHYSEGRIEVLADMIVQQMIGYGKLDPLVRDDNLEEIMVIGTNRPVYVWHRRFNMCKTNVIFDSDRDILNIIERIAREVGRRIDQQSPLLDARLPDGSRVNATIPPISLDGPTITIRKFKRDPLTIIDLIKYGTMSSEVAAFLWVLVDGLGVKPANVLVAGGTGSGKTTTLNSLGMFIPPSERVISIEDTAELQLPVEHWVRLETRPPNLEGKGEVTMDDLVRNTLRMRPDRIIVGEVRGPEARTMFTAMNTGHNG

SEQ ID NO: 922 - protein, 345 aa, Thermococcus kodakaraensis KOD1
  Tko LHR N-extein
MSGIRWAEREYTDEEIYSILSEPVREWFKRKFGTFTPPQRYAVLEIHKGENVLISSPTGSGKTLSAFLSAINELILLGKESKLEDKIYVLYVSPLRALNNDIKRNLEGPLAEIKEVAKELGYELPEIRVGIRTSDTSSYEKSKMVKKPPHILITTPESLAIALNAPKFSERLKTVKYVIIDEVHALAENKRGSHLALSIERLQEMAENEFVRIGLSATIHPLEEVAKFVFGFNDDGTPRPGLIVDVSFAKQTEIKVESVVEDLIYTDAGTLSDALYNRLAELIREHRTTLIFTNTRSGAERVAFNLKKRFPEFEGLIEAHHSSLSREVRLDVEEKLKRGELKAVV

SEQ ID NO: 923 - protein, 406 aa, Pyrococcus/ Thermococcus kodakaraensis KOD1
  Tko Pol-1 (Pko Pol-1) N-extein
MILDTDYITEDGKPVIRIFKKENGEFKIEYDRTFEPYFYALLKDDSAIEEVKKITAERHGTVVTVKRVEKVQKKFLGRPVEVWKLYFTHPQDVPAIRDKIREHGAVIDIYEYDIPFAKRYLIDKGLVPMEGDEELKMLAFDIQTLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITPAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFR

SEQ ID NO: 924 - protein, 851 aa, Pyrococcus/Thermococcus kodakaraensis KOD1
  Tko Pol-2 (Pko Pol-2) N-extein
MILDTDYITEDGKPVIRIFKKENGEFKIEYDRTFEPYFYALLKDDSAIEEVKKITAERHGTVVTVKRVEKVQKKFLGRPVEVWKLYFTHPQDVPAIRDKIREHGAVIDIYEYDIPFAKRYLIDKGLVPMEGDEELKMLAFDIQTLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITPAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRCHPADTKVVVKGKGIINISEVQEGDYVLGIDGWQRVRKVWEYDYKGELVNINGLKCTPNHKLPVVTKNERQTRIRDSLAKSFLTKKVKGKIITTPLFYEIGRATSENIPEEEVLKGELAGILLAEGTLLRKDVEYFDSSRKKRRISHQYRVEITIGKDEEEFRDRITYIFERLFGITPSISEKKGTNAVTLKVAKKNVYLKVKEIMDNIESLHAPSVLRGFFEGDGSVNRVRRSIVATQGTKNEWKIKLVSKLLSQLGIPHQTYTYQYQENGKDRSRYILEITGKDGLILFQTLIGFISERKNALLNKAISQREMNNLENNGFYRLSEFNVSTEYYEGKVYDLTLEGTPYYFANGILTHNSLYPSIIITHNVSPDTLNREGCKEYDVAPQVGHRFCKDFPGFIPSLLGDLLEERQKIKKKMKATIDPIERKLLDYRQRAIKILAN

SEQ ID NO: 925 - protein, 963 aa, Thermococcus kodakaraensis KOD1
  Tko Pol-II N-extein
MSEEIYSPEMKAYFESLQREIDRAYAIARKARAQGKDPSFDVEVPQATDMAGRVESLVGPPGVAERIRELVKEYGKEIAALKVVDEIIEGKFGDLGSKEKYAEQAVRTALAILTEGIVSAPLEGIADVKIKRNEWADGSEYLALYYAGPIRSSGGTAQALSVLVGDYVRRKLGLDRFKPSDEHIERMVEEVDLYHRAVTRLQYHPEADEVRLAMRNIPIEITGEETDKVEVSHRNVPGVETNHLRGGAILVLAEGVLQKAKKLVKYIDKMGIEGWDWIKEFVEAKEKGKSSEENKDESKAEDTGTESVAEKKENVEKGFYYELYEKFRANIAPNKKYTKEIIGGRPLFAEPSTNGGFRLRYGRSRVSGFATWSVNPATMLILDEFIAIGTQMKTERPGKGCIVTPATTVEGPIVRLKNGSVVRVDDYETALKVRNEVDEILYVGDALVNFGDFVENNQTLLPANYVEEWWVQELVQAIKDLYEVELQPFAENDREAVEEAAEYLEVDPDFLWNLLKDPLRVKPDVETAIHLSTVLDIPFHPYYTLYWNTLQPEEVEELQKALLGAQIEWAEFRKNRFAKKVVLENDKNIKRYLELLGLPHRLERVEKKRKVIVVEYPWSAALLTPLGNLEWEFKAKPFYTVIDIINENNRIKLRDRGISWIGARMGRPEKAKERKMKPPVQVLFPIGLAGGQSRDIKKAAEEGKTARVEIAFFKCPKCGHVGPEHLCPVCGTRKELLWHCPKCGADYPESDAKDFNYRCPKCDVELKPYAEREIKPADLLRQAMDNVKVYGIDRLKGVKGMTSGYKMAEPLEKGLLRVKNDVYVFKDGTIRFDATDAPITHFKPKEIGTSVEKLRELGYTHDFEGKPLERDDQILELKVQDVILPYEAGRYLLKVARFIDDLLEKFYGLPRFYNAEKMEDLVGHLVIGLAPHTSAGIIGRIIGFSDVLVGYAHPYYHAAKRRN

SEQ ID NO: 926 - protein, 960 aa, Thermococcus kodakaraensis KOD1
  Tko r-Gyr N-extein
MKAVYREMCPNCWGRISDERLVMRNPCEECLDEPVHADSYFQLVSAVRNALKLRGTLKEWEKIYQLENQTREIEEFFKKATGFTFWSAQRTWVKRLLKGRSFSIIAPTGMGKSTFGAFMAVWHALKGKKSYIVVPTTPLVIQTVRKIEGIMENANADVRLAYYHGNLRKKEKEEMLERIKNEDYDILVTSAQWLARNYEEVLKGRHFDFIFVDDVDAFLKASKNIDRSLYLLGFTDEIIQKAWEIIRLKKQMSRYLNGNSEDRNEKLNGLNREIEKLQREIEKFKRKNKIGIMIIASATGSARGDRIKLYRELLGFEVGSGRSALRNVVDSYLKPTKDIKEHVEELLTRLGKGGLIFVPVDQGLGYAEELANYLSEKGFKIELVSSKNKKALEKFENGEADYLIGSATYYGSLVRGIDLPHLIRYAVFTGVPKFRFSIDLERPTIYRALGLLSEIMDFLSEEDRRQAEKLHARLRRLIRNIPQFELLKIEEALAEGLPIENEFHNHVLGVFRELVEFLRRVLRDEEVLRKLAEDPFISLVKEEGKWYIEIPDVRTYIQATGRTSRLFAGGITKGLSVLIVDNEKVFNGLVRQMRWRFQEFKMVPFEELDLDEILRQIDEDREKVRLVMEGKISAKVKDLVRSALMIVESPNKARTIANFFGQPSKTRIGDLVAYEISVGDRMLTILASGGHMFDLVTNEGYHGVLIQNEGDMLKFIPVYDTLKRCRDCGHQFVDWEKKGVCPRCGSTNVRDALENVIAMREIAQEVDEILIATDPDTEGEKIAWDIRNVLAPYTPNIKRIEFHEVTRPAIMKAIQEARDVNENRVNAQIVRRIEDRWIGFELSQELQRVFESYNLSAGRVQTPVLGWIIERYKEFTESEVYFLGLTLENGLQVTIELGKDGKDVEPPEYVTVEEVQLEERELNPAPPYTTDAMLKDASTFLKLSAPETMRLAQDLFEAGL

SEQ ID NO: 927 - protein, 149 aa, Thermococcus kodakaraensis KOD1
  Tko RadA N-extein
MARKKKVEDEVKELEEFEELDVEESLSSSDKQSKPEKKISALEDLPGVGPATAEKLREAGYDTIEAIAVASPLELKEIAGISEGAALKIIQAAREAANIGTFMRADEYMKRRTTIGKISTGSKALDKLLGGGIETQAITEVFGEFGSGK

SEQ ID NO: 928 - protein, 301 aa, Thermococcus kodakaraensis KOD1
  Tko RIR1-1 N-extein
MPVEKVMKRDGRIVPFDKERIRWAIQRAMLEVGVRDEKLLNRVVRRVVRRVNELYDGQIPNIENIQDIVELELMRAGLFDVAKAYILYRKKKAEIREEKKKILNKDKLDEIDKRFSLNALRVLASRYLIKNEKGEIIESPRELFERVAILAVIPDILYDERVFDKNGGHEQDVSAIERYRENLDEYDGKFSIGRFRLNKWHFERLLNLYRELAEKGQMKLPIDEVLKMLENGAFDNYEDEIEEYFRLMTGQYFMPNTPALINSGRPLGMLSACFVVPIEDDMESIMKAAHDVAMIQKAGGG

SEQ ID NO: 929 - protein, 914 aa, Thermococcus kodakaraensis KOD1
  Tko RIR1-2 N-extein
MPVEKVMKRDGRIVPFDKERIRWAIQRAMLEVGVRDEKLLNRVVRRVVRRVNELYDGQIPNIENIQDIVELELMRAGLFDVAKAYILYRKKKAEIREEKKKILNKDKLDEIDKRFSLNALRVLASRYLIKNEKGEIIESPRELFERVAILAVIPDILYDERVFDKNGGHEQDVSAIERYRENLDEYDGKFSIGRFRLNKWHFERLLNLYRELAEKGQMKLPIDEVLKMLENGAFDNYEDEIEEYFRLMTGQYFMPNTPALINSGRPLGMLSACFVVPIEDDMESIMKAAHDVAMIQKAGGGCIDGNAKIIFENDGEEHIMTMAEMYERYKDLGEFYDPEYNRWGINVEEVPVYVKSFDPSTKEITKGKVKVIWKYELGEDVPKYEIKTNKGTRVLTSPWHPFFVITQDLKIVEKRADELREGDMLVGGMPSDDDYEFLLDYWLAGFIAGDGSIDKYRSHVKGHEYVYDRLRIYDYTTETLGIINDHLEKTFGKRYSLQRDRNIHYIDIKAKGITSHYIELLRGITNGIPQPILKEGRNAVLSFITGLFDAEGHVNSKPGVELGMVNRKLIEDITYYLNSLGIKARMRKKPRKDGVDYVMHVEEYSSLLRFYELIGKNLQNSEKRIKLEELLSKHNGGSFGLTLSFEDFKAWSSKYGVEFKTNGSQTLAIIKNEKVSLGQWHRRGRVSKAVLVKMLRKLYDTTKSEDVKRMLHLIEGLEVVKEINVTNEPKTFYDLTVERYQNYLAGENGMVFVHNTGLNFSKLRPEGDLVGTTTGAASGPVSFMHLIDAVSDVIKQGGVRRGANMGILEVWHPDIEKFIHAKEKNTGTNVLSNFNISVGLWEDFWEALKEGKRYPLINPRTGEKVKEIDPKSLFEELAYMAWAKADPGVVFFDVINRRNVLEPAKGEKIRATNP

SEQ ID NO: 930 - protein, 315 aa, Thermococcus kodakaraensis KOD1
  Tko TopA N-extein
MVTLIIAEKPNVARKIAYALAEGKPVRKTIGKVSYYEFTRDGKKVIVAPAVGHLFSLAPKTKTYGYPVFDIEWVPVYVAEKGKSYAKDYIKALATLAKQADEFVVACDYDTEGEVIGYTALKYACGVDPSKAKRMKFSALTKKDLLKAWYNMEPTINFGMADAGIARHVLDWYWGVNLSRALTSAIKRASGKWMVLSTGRVQGPTLKFLVEREKEIQNFEPKPYWVIKMLLEKNGGQYTAVYEKEKVWDEEEAKKIVEEAKKGPAFVEKVEVKQQNRNPPVPFDLGTLQREAYSAFGYSPKKTLDIAQKLYEKGY

SEQ ID NO: 931 - protein, 494 aa, Thermococcus litoralis
  Tli Pol-1 N-extein
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLAN

SEQ ID NO: 932 - protein, 1081 aa, Thermococcus litoralis
  Tli Pol-2 N-extein
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSILPNEWLPIIENGEIKFVKIGEFINSYMEKQKENVKTVENTEVLEVNNLFAFSFNKKIKESEVKKVKALIRHKYKGKAYEIQLSSGRKINITAGHSLFTVRNGEIKEVSGDGIKEGDLIVAPKKIKLNEKGVSINIPELISDLSEEETADIVMTISAKGRKNFFKGMLRTLRWMFGEENRRIRTFNRYLFHLEKLGLIKLLPRGYEVTDWERLKKYKQLYEKLAGSVKYNGNKREYLVMFNEIKDFISYFPQKELEEWKIGTLNGFRTNCILKVDEDFGKLLGYYVSEGYAGAQKNKTGGISYSVKLYNEDPNVLESMKNVAEKFFGKVRVDRNCVSISKKMAYLVMKCLCGALAENKRIPSVILTSPEPVRWSFLEAYFTGDGDIHPSKRFRLSTKSELLANQLVFLLNSLGISSVKIGFDSGVYRVYINEDLQFPQTSREKNTYYSNLIPKEILRDVFGKEFQKNMTFKKFKELVDSGKLNREKAKLLEFFINGDIVLDRVKSVKEKDYEGYVYDLSVEDNENFLVGFGLLYAHNSYYGYMGYPKARWYSKECAESVTAWGRHYIEMTIREIEEKFGFKVLYAD

SEQ ID NO: 933 - protein, 18 aa, Torulaspora pretoriensis, strain CBS 5080
  Tpr VMA N-extein
ISQSLSKYSNSDAIIYVG

SEQ ID NO: 934 - protein, 491 aa, Thermococcus species GE8
  Tsp-GE8 Pol-1 N-extein
MILDTDYITEDGKPVIRVFKKENGEFKIEYDRNFEPYFYALLKDDSAIEEVKKITAKRHGTVVKVKRAEKVKKKFLGRPIEVWKLYFTHPQDVPAIRDKIREHPAVIDIYEYDIPFAKRYLIDKGLIPMEGDEKLKMLAFDIETLYHEGEEFAEGPILMISYADEEGARVITWKKVDLPYVDVVSTEKEMIKRFLRVVKEKDPDVLITYNGDNFDFAYLKRRSEKLGVKFILGRDGSEPKIQRMGDRFAVEVKGRIHFDLYPVIRRTINLPTYTLEAVYEAIFGKPKEKVYAEEIATAWETGEGLERVARYSMEDAKVTFELGKEFFPMEAQLSRLIGQSLWDVSRSSTGNLVEWFLLRKAYERNELAPNKPDERELARRRQSYAGGYVKEPERGLWNNIVYLDFRSLYPSIIITHNVSPDTLNREGCKEYDVAPQVGHKFCKDFPGFIPSLLGDLLEERQKIKRKMRATIDPVEKKLLDYRQRAIKILAN

SEQ ID NO: 935 - protein, 1075 aa, Thermococcus species GE8
  Tsp-GE8 Pol-2 N-extein
MILDTDYITEDGKPVIRVFKKENGEFKIEYDRNFEPYFYALLKDDSAIEEVKKITAKRHGTVVKVKRAEKVKKKFLGRPIEVWKLYFTHPQDVPAIRDKIREHPAVIDIYEYDIPFAKRYLIDKGLIPMEGDEKLKMLAFDIETLYHEGEEFAEGPILMISYADEEGARVITWKKVDLPYVDVVSTEKEMIKRFLRVVKEKDPDVLITYNGDNFDFAYLKRRSEKLGVKFILGRDGSEPKIQRMGDRFAVEVKGRIHFDLYPVIRRTINLPTYTLEAVYEAIFGKPKEKVYAEEIATAWETGEGLERVARYSMEDAKVTFELGKEFFPMEAQLSRLIGQSLWDVSRSSTGNLVEWFLLRKAYERNELAPNKPDERELARRRQSYAGGYVKEPERGLWNNIVYLDFRSLYPSIIITHNVSPDTLNREGCKEYDVAPQVGHKFCKDFPGFIPSLLGDLLEERQKIKRKMRATIDPVEKKLLDYRQRAIKILANSILPDEWLPLLVNGRLKLVRIGDFVDNTMKKGQPLENDGTEVLEVSGIEAISFNRKTKIAEIKPVKALIRHRYRGKVYDIKLSSGRNIKVTEGHSLFAFRDGELVEVTGGEIKPGDFIAVPRRVNLPERHERINLIEILLGLPPEETSDIVLTIPVKGRKNFFKGMLRTLRWIFEEEQRPRTARRYLEHLQKLGYVKLMKRAYEIVNKEALRNYRKLYEVLAERVKYNGNKREYLVHFNDLRNEIKFMPDEELEEWKVGTLNGFRMEPFIEVGEDFAKLLGYYVSEGYARKQRNQKNGWSYSVKIYNNDQRVLDDMEKLASKFFGRVRRGKNYVEISRKMAYVLFESLCGTLAENKRVPEVIFTSPESVRWAFFEGYFIGDGDLHPSKRVRLSTKSEELVNGLVVLLNSLGISAIKIRFDSGVYRVLVNEELPFLGNRKRKNAYYSHVIPKEILEETFGKQFQKNMSPAKLNEKVEKGELDAGKARRIAWLLEGDIVLDRVEKVTVEDYEGYVYDLSVEENENFLAGFGMLYAHNSYYGYYGYAKARWYCRECAESVTAWGRSYIETTIREIEEKFGFKVLYAD

SEQ ID NO: 936 - protein, 491 aa, Thermococcus species GT
  Tsp-GT Pol-1 N-extein
MILDTDYITEDGKPVIRIFKKENGEFKIEYDREFEPYIYALLKDDSAIEDVKKITAGRHGRVVKVKRAEKVKKKFLGRPIEVWKLYFTHPQDVPAIRDEIRKHPAVIDIYEYDIPFAKRYLIDRGLIPMEGDEELKMMSFDIETLYHEGEEFGTGPILMISYADEGEARVITWKKIDLPYVEVVSTEKEMIKRFLKVVKEKDPDVLITYNGDNFDFAYLKKRCEKLGIKFTLGRDGSEPKIQRMGDRFAVEVKGRIHFDLYPVIRRTINLPTYTLEAVYEAVFGTPKEKVYPEEITTAWETGEGLERVARYSMEDAKVTYELGREFFPMEAQLSRLIGQSLWDVSRSSTGNLVEWFLLRKAYERNEIAPNKPDERELARRRGGYAGGYVKEPERGLWDNIVYLDFMSLYPSIIITHNVSPDTLNREGCKEYDTAPQVGHKFCKDVQGFIPSLLGALLDERQKIKKRMKASIDPLEKKLLDYRQKAIKILAN

SEQ ID NO: 937 - protein, 1077 aa, Thermococcus species GT
  Tsp-GT Pol-2 N-extein
MILDTDYITEDGKPVIRIFKKENGEFKIEYDREFEPYIYALLKDDSAIEDVKKITAGRHGRVVKVKRAEKVKKKFLGRPIEVWKLYFTHPQDVPAIRDEIRKHPAVIDIYEYDIPFAKRYLIDRGLIPMEGDEELKMMSFDIETLYHEGEEFGTGPILMISYADEGEARVITWKKIDLPYVEVVSTEKEMIKRFLKVVKEKDPDVLITYNGDNFDFAYLKKRCEKLGIKFTLGRDGSEPKIQRMGDRFAVEVKGRIHFDLYPVIRRTINLPTYTLEAVYEAVFGTPKEKVYPEEITTAWETGEGLERVARYSMEDAKVTYELGREFFPMEAQLSRLIGQSLWDVSRSSTGNLVEWFLLRKAYERNEIAPNKPDERELARRRGGYAGGYVKEPERGLWDNIVYLDFMSLYPSIIITHNVSPDTLNREGCKEYDTAPQVGHKFCKDVQGFIPSLLGALLDERQKIKKRMKASIDPLEKKLLDYRQKAIKILANSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRNVSYEKFRELVKSEKLDGEKAKRIEWLLNGDVVLDKVLEVKKRPYEGYVYDLSVEEDENFLAGFGLLYAHNSYYGYYGYARARWYCKECAESVTAWGRDYIETTIHEIEERFGFKVLYAD

SEQ ID NO: 938 - protein, 767 aa, Thermus thermophilus HB27
  Tth-HB27 DnaE-1 N-extein
MGRKLRFAHLHQHTQFSLLDGAAKLSDLLKWVKETTPEDPALAMTDHGNLFGAVEFYKKATEMGIKPILGYEAYVAAESRFDRKRGKGLDGGYFHLTLLAKDFTGYQNLVRLASRAYLEGFYEKPRIDREILREHAEGLIALSGCLGAEIPQFILQDRLDLAEARLNEYLSIFKDRFFIEIQNHGLPEQKKVNEVLKEFARKYGLGMVATNDGHYVRKEDARAHEVLLAIQSKSTLDDPGRWRFPCDEFYVKTPEEMRAMFPEEEWGDEPFDNTVEIARMCNVELPIGDKMVYRIPRFPLPEGRTEAQYLMELTFKGLLRRYPDRITEGFYREVFRLLGKLPPHGDGEALAEALAQVEREAWERLMKSLPPLAGVKEWTAEAIFHRALYELSVIERMGFPGYFLIVQDYINWARRNGVSVGPGRGSAAGSLVAYAVGITNIDPLRFGLLFERFLNPERVSMPDIDTDFSDRERDRVIQYVRERYGEDKVAQIGTLGSLASKAALKDVARVYGIPHKKAEELAKLIPVQFGKPKPLQEAIQVVPELRAEMEKDPKVREVLEVAMRLEGLNRHASVHAAGVVIAAEPLTDLVPLMRDQEGRPVTQYDMGAVEALGLLKMDFLGLRTLTFLDEVKRIVKASQGVELDYDALPLDDPKTFALLSRGETKGVFQLESGGMTATLRGLKPRRFEDLIAILSLYRPGPMEHIPTYIRRHHGLEPVSYSEFPHAEKYLKPILDETYGIPVYQEQIMQIASAVAGYSLGEADLLRR

SEQ ID NO: 939 - protein, 1238 aa, Thermus thermophilus HB27
  Tth-HB27 DnaE-2 N-extein
MGRKLRFAHLHQHTQFSLLDGAAKLSDLLKWVKETTPEDPALAMTDHGNLFGAVEFYKKATEMGIKPILGYEAYVAAESRFDRKRGKGLDGGYFHLTLLAKDFTGYQNLVRLASRAYLEGFYEKPRIDREILREHAEGLIALSGCLGAEIPQFILQDRLDLAEARLNEYLSIFKDRFFIEIQNHGLPEQKKVNEVLKEFARKYGLGMVATNDGHYVRKEDARAHEVLLAIQSKSTLDDPGRWRFPCDEFYVKTPEEMRAMFPEEEWGDEPFDNTVEIARMCNVELPIGDKMVYRIPRFPLPEGRTEAQYLMELTFKGLLRRYPDRITEGFYREVFRLLGKLPPHGDGEALAEALAQVEREAWERLMKSLPPLAGVKEWTAEAIFHRALYELSVIERMGFPGYFLIVQDYINWARRNGVSVGPGRGSAAGSLVAYAVGITNIDPLRFGLLFERFLNPERVSMPDIDTDFSDRERDRVIQYVRERYGEDKVAQIGTLGSLASKAALKDVARVYGIPHKKAEELAKLIPVQFGKPKPLQEAIQVVPELRAEMEKDPKVREVLEVAMRLEGLNRHASVHAAGVVIAAEPLTDLVPLMRDQEGRPVTQYDMGAVEALGLLKMDFLGLRTLTFLDEVKRIVKASQGVELDYDALPLDDPKTFALLSRGETKGVFQLESGGMTATLRGLKPRRFEDLIAILSLYRPGPMEHIPTYIRRHHGLEPVSYSEFPHAEKYLKPILDETYGIPVYQEQIMQIASAVAGYSLGEADLLRRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSMGKKKVEEMKSHRERFVQGAKERGVPEEEANRLFDMLEAFANYGFNK

SEQ ID NO: 940 - protein, 298 aa, Thermus thermophilus HB27
  Tth-HB27 RIR1-1 N-extein
MRDGYFFDEHAQAIARRQYLQPGDGDILGMFRRVAREIAKAEREEERSKWEEEFFRLMAEKRFSPGGRILAGAGTVHGNLLNCFVQGATENPPESFAGIMEVAKKLALVTKVGGGNGVNLDPYRSKGKRARRAVEGVAYLSAEHPDVEDFIRGLMRPPINPDGAKEEISLKNFARVVYGALSPELKALAERYGVRTVKEPPEGRILVPDDMGGIIDAAREAADLARKGQKPHVDFSLLRPEGAPIRGSGGTSSGPVSFLFEIFDNFLEWVAWGAEEAGPVATLRYVYAPVLRVVRQGG

SEQ ID NO: 941 - protein, 885 aa, Thermus thermophilus HB27
  Tth-HB27 RIR1-2 N-extein
MRDGYFFDEHAQAIARRQYLQPGDGDILGMFRRVAREIAKAEREEERSKWEEEFFRLMAEKRFSPGGRILAGAGTVHGNLLNCFVQGATENPPESFAGIMEVAKKLALVTKVGGGNGVNLDPYRSKGKRARRAVEGVAYLSAEHPDVEDFIRGLMRPPINPDGAKEEISLKNFARVVYGALSPELKALAERYGVRTVKEPPEGRILVPDDMGGIIDAAREAADLARKGQKPHVDFSLLRPEGAPIRGSGGTSSGPVSFLFEIFDNFLEWVAWGAEEAGPVATLRYVYAPVLRVVRQGGCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYGVRVVTAKGLERYLERIGVPKGSRLEALHGIKPDVRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNTRRGAGMATLSIEHPDLLDFLTAKDLDREKAEGDISTFNISVLATDRFLEAVEKDELWPVTPIEVPGKYYPYPVEGPYTGKLPSLPEREDGAKAIPLYGGKVPARWLWHEIAWHAWATGEPGLIFVDRVNALSALKGLGERYQIRSTNP

SEQ ID NO: 942 - protein, 767 aa, Thermus thermophilus HB8; identical to SEQ ID NO: 938
  Tth-HB8 DnaE-1 N-extein

SEQ ID NO: 943 - protein, 1238 aa, Thermus thermophilus HB8
  Tth-HB8 DnaE-2 N-extein
MGRKLRFAHLHQHTQFSLLDGAAKLSDLLKWVKETTPEDPALAMTDHGNLFGAVEFYKKATEMGIKPILGYEAYVAAESRFDRKRGKGLDGGYFHLTLLAKDFTGYQNLVRLASRAYLEGFYEKPRIDREILREHAEGLIALSGCLGAEIPQFILQDRLDLAEARLNEYLSIFKDRFFIEIQNHGLPEQKKVNEVLKEFARKYGLGMVATNDGHYVRKEDARAHEVLLAIQSKSTLDDPGRWRFPCDEFYVKTPEEMRAMFPEEEWGDEPFDNTVEIARMCNVELPIGDKMVYRIPRFPLPEGRTEAQYLMELTFKGLLRRYPDRITEGFYREVFRLLGKLPPHGDGEALAEALAQVEREAWERLMKSLPPLAGVKEWTAEAIFHRALYELSVIERMGFPGYFLIVQDYINWARRNGVSVGPGRGSAAGSLVAYAVGITNIDPLRFGLLFERFLNPERVSMPDIDTDFSDRERDRVIQYVRERYGEDKVAQIGTLGSLASKAALKDVARVYGIPHKKAEELAKLIPVQFGKPKPLQEAIQVVPELRAEMEKDPKVREVLEVAMRLEGLNRHASVHAAGVVIAAEPLTDLVPLMRDQEGRPVTQYDMGAVEALGLLKMDFLGLRTLTFLDEVKRIVKASQGVELDYDALPLDDPKTFALLSRGETKGVFQLESGGMTATLRGLKPRRFEDLIAILSLYRPGPMEHIPTYIRRHHGLEPVSYSEFPHAEKYLKPILDETYGIPVYQEQIMQIASAVAGYSLGEADLLRRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVPPAVAYRISEAKRRSGLSWSEAGRRVAVAGSCLSSGLNLKRPRRYLFRHRLFLLGEAFADPGLEALAEGQVLWDPIVAVEPAGKARTFDLRVPPFANFVSEDLVVHNSMGKKKVEEMKSHRERFVQGAKERGVPEEEANRLFDMLEAFANYGFNK

SEQ ID NO: 944 - protein, 887 aa, Thermus thermophilus HB8
  Tth-HB8 RIR1-2 N-extein
MDMRDGYFFDEHAQAIARRQYLQPGDGDILGMFRRVAREIAKAEREEERSKWEEEFFRLMAEKRFSPGGRILAGAGTVHGNLLNCFVQGATENPPESFAGIMEVAKKLALVTKVGGGNGVNLDPYRSKGKRARRAVEGVAYLSAEHPDVEDFIRGLMRPPINPDGAKEEISLKNFARVVYGALSPELKALAERYGVRTVKEPPEGRILVPDDMGGIIDAAREAADLARKGQKPHVDFSLLRPEGAPIRGSGGTSSGPVSFLFEIFDNFLEWVAWGAEEAGPVATLRYVYAPVLRVVRQGGCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYRVRVVTAKGLERYLERIGVPKGSRLEALHGIKPDIRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNTRRGAGMATLSIEHPDLLDFLTAKDLDREKAEGDISTFNISVLATDRFLEAVEKDELWPVTPIEVPGKYYPYPVEGPYTGKLPPLPEREDGAKAIPLYGGKVPARWLWHEIAWHAWATGEPGLIFVDRVNALSALKGLGERYQIRSTNP

SEQ ID NO: 945 - protein, 491 aa, Thermococcus zilligii
  Tzi Pol N-extein
MILDADYITEDGKPVIRVFKKEKGEFKIDYDRDFEPYIYALLKDDSAIEDIKKITAERHGTTVRVTRAERVKKKFLGRPVEVWKLYFTHPQDVPAIRDKIREHPAVVDIYEYDIPFAKRYLIDRGLIPMEGDEELRMLAFDIETLYHEGEEFGEGPILMISYADEEGARVITWKNIDLPYVESVSTEKEMIKRFLKVIQEKDPDVLITYNGDNFDFAYLKKRSETLGVKFILGRDGSEPKIQRMGDRFAVEVKGRIHFDLYPVIRRTINLPTYTLETVYEAIFGQPKEKVYAEEIARAWESGEGLERVARYSMEDAKATYELGKEFFPMEAQLSRLVGQSLWDVSRSSTGNLVEWFLLRKAYERNELAPNKPDERELARRAESYAGGYVKEPEKGLWENIVYLDYKSLYPSIIITHNVSPDTLNREGCREYDVAPQVGHRFCKDFPGFIPSLLGDLLEERQKVKKKMKATVDPIERKLLDYRQRAIKILAN

SEQ ID NO: 946 - protein, 33 aa, uncultured archaeon GZfos13E1
  Unc-ERS PFL N-extein
MNIGGFQRFSLIDYPGKICAIVFTQGCNFRCPY

SEQ ID NO: 947 - protein, 289 aa, uncultured archaeon GZfos9C4
  Unc-ERS RIR1 N-extein
MKTTVSKIRKKNFIGAKDDLKLSLNAVEVLKRRYLLKNELGGVIETPSQMFKRVAKAIARAELNYGKSKEEVKEIERRFYLLMRNLEFLPNSPTLMNAGTELGQLAACFVLPVEDSIGGIFGAVKKMAKIHQSGGGTGFSFSRLRPKGDVVKSTGGVASGPVSFMRVFDVATDVIKQGGKRRGANMGILNAEHPDILEFIRAKERGEFANFNTSVAVTDEFMRAVERNDEYGLVNPRTKGEVKRIKAREVFNEIVTYAWKTGDPGIVFMDEINRRNTIPAVGKIEATNP

SEQ ID NO: 948 - protein, 408 aa, uncultured archaeon (Rice Cluster I)
  Unc-MetRFS MCM2 N-extein
MAASVISSVARWKEFLTRYYKNQIQQLAVSDVKNKALAIEFPNITKFDVRLAEELLNNPDLVLSHAEDALTLVDLPVKTQVSAKIRVIKVPRKTQVRELRSSDVNKLVSLEGTVRKITDVRPRILEAAFECARCKNIIYIPQEGSGKFIEPSYCQCNEEKKGIFRLMYKESRFEDYQRIKIQESPENLKGGEQPQTLDINVSDDLAGIVTPGEFITVTGILRSAQRVNKDGKTAYFDIYLDGVAVELEEQEFDEVEISLEDEEEILRMSRDPEIYQKVIGSIAPSIYGYDEVKEAVAHQLFSGVVKELPDGSRIRGDIHVLLVGDPGIAKSQILRYVVKLAPRGVYASGKSASSAGLTAAAVKDEFDGQWTLEAGALVLADKGIAAIDEMDKMKNEDRSSLHEGMEQQ

SEQ ID NO: 949 - protein, 18 aa, Vanderwaltozyma polyspora, formerly Kluyveromyces polysporus, strain CBS 2163
  Vpo VMA N-extein
ISQSLSKYSNSDAIIYVG

SEQ ID NO: 950 - protein, 173 aa, Wiseana iridescent virus
  WIV RIR1 N-extein
QTRRGSYAAYLDITHPEIISFLNTRRVSGVGGDYNFKLMNIHNAVNIPDEFMRKIWFISTVTPLLRENKYLKIEETIKEIKNSNKWVEFSELKIEDFTPQNSQKFIKEMDKWNLFDPHTKKVKETISATELWERILITRAETGEPYLHFIDASNRNLPSFQKKLGLRVKQSNL

SEQ ID NO: 951 - protein, 18 aa, Zygosaccharomyces bailii, strain CBS 685
  Zba VMA N-extein
ISQSLSKYSNSDAIIYVG

SEQ ID NO: 952 - protein, 18 aa, Zygosaccharomyces rouxii, strain CBS 688
  Zro VMA N-extein
ISQSLSKFSNSDAIVYVG

SEQ ID NO: 953 - protein, 121 aa, Aquifex aeolicus strain VF5
  Aae RIR2 C-extein
CHVTLFRNIINTLRKENPELFTPEIEKWIVEYFKYAVNEEIKWGQYVTQNQILGINDVLIERYIKYLGNLRITQIGFDPIYPEVTENPLKWIDEFRKINNTKTDFFQAKPQTYSKANELKW

SEQ ID NO: 954 - protein, 313 aa, Acidovorax avenae subsp. citrulli AAC00-1
  Aave Hyp-1721 C-extein
TFKTYSVSYLELMHRMWTQGGPEGKRAVGWAIAMLLLMSGAGGLPFMEDAEDLIDGAAQMMGYNLSSKQWRKQLLADVMGKEIADFVEQGVSGLPGAPVDVSGRMGLGNLLPGTGLLLSKQNRERDLLEVAGPAGDLIARGFTAGRKLLTGDAGGAALEVAPTAVRNAVKGVDMAATGIYKDKKGYKVIDTTLAEAGAKFLGFQPKSVAEVQEANSFMQRTKTFYTQTSSEIKAQWADALFRKDDAALAEARERLADWNRNNPEQPIVVKMPDVWKRVREMGKDRTQRIADTAPKALRQQMREAAREAGQAPA

SEQ ID NO: 955 - protein, 537 aa, Acidovorax avenae subsp. citrulli AAC00-1
  Aave RIR C-extein
CGEQPLPSYGCCDLGPIILPRFVRHPFGFAGEPAFDFDAFAASVATQVRALDNVLDVTFWPLPQQRAESAAKRRIGVGFTGLGNTLAMLRLRYDTDAGRAMAMRIAECMRDAAYAASVELAKEKGVFPKFDAAGYLAPGTFASRLPAALQEAIRTHGIRNSHLLSIAPTGTVSLAFADNASNGIEPPFSWTYTRRKREADGSTSEYAVEDHAWRLYGALGGDVNALPDYFVSALQMPAAGHIAMMEAVQPFIDTAISKTVNMPADYPYEDFKNLYLHAWRARLKGLATYRPNAILGAVLEAPAAAPEAGTATTSAAHDASESADRPAVQSSAMPPATPADPMRAVIESRPKGALSAVAEKVEYWTQEGRKTLYLIVSFLPVPDGHGGTVDRAIEFFMPVGQSGESQQWITSSMRLLSLAARGGFLERALSDMRKVAWDRGPVRLGTHTRADGARVPLWHDSEVAAIAYAIQNILAQRAAAPAGPMRQQELPLDAPAAPTGLPPAMAGRKCPECGAHAVIRKDGCDYCTQCGNLGSCG

SEQ ID NO: 956 - protein, 8 aa, Aspergillus brevipes FRR2439
  Abr PRP8 C-extein
SGFEESMK

SEQ ID NO: 957 - protein, 789 aa, Acidothermus cellulolyticus 11B
  Ace RIR1 C-extein
CFILSVDDTMESILDWYKEEGLIFKGGSGAGVNLSRIRSSKELLSSGGTASGPVSFMRGADASAGTIKSGGATRRAAKMVILDVDHPDIEEFIETKVREEEKIRVLRDAGFDMDLGGRDLYSVQYQNANNSVRVSDEFMRAVERGESFGLRARTTGEVIETVDARKLFRKMAEAAWACADPGIQYDDTINDWHTCPESGRITASNPCSEYMHLDNSSCNLASLNLMKFLTDDGRFDIDTFIKVVELVITAMDISICFADFPTEKIADTTRRFRQLGIGYANLGALLMATGHAYDSDGGRALAAAITSLMTATAYKRSAELAAIVGPYDGYARNAEAHKRVMRKHAAASDALRTIGEMDRAIAERACQMWRECLTLGEQHGWRNSQASVLAPTGTIGLAMDCDTTGIEPDLALVKFKKLVGGGSMQIVNRTVPRALRTLGYPEEQVEAIVEYISEHGSVVGAPGLRPEHYEVFDCAMGDRAISPMGHVRMMAAVQPFISGAISKTVNMPESATVEDVEEIYFQGWKLGLKALAIYRNNCKVGQPLSDAKEKKVSAAVEGSHEHRPVRRRLPKRRPSQTISFSVGGAEGYLTAGSYPDNGLGEVFLKLGKQGSTLAGVMDAFAIAISIALQYGVPLEAFVSKFVNMRFEPSGMTDDPDIRFASSIMDYIFRRLALDYLPYEKREELGIFSAEERARKQSGELSAASAEPLADETADSVTADDAEARADTAVAGSAPRATTPGLGGHGAAELVDRVFGQAADAPLCMNCGTTMRPAGSCYVCEGCGSTSGCS

SEQ ID NO: 958 - protein, 654 aa, Alkalilimnicola ehrlichei MLHE-1
  Aeh DnaB-1 C-extein
TTWAMNIVEHAAMKQEAPTAVFSMEMPGDSLAMRMLSSLGRVELQRIRSGRLEDDDWPRLTSTLSLLSQAKLFIDDTPGLSPSEMRARARRLKREHGLGLIVIDYLQLMQLPGAKENRAQELSEISRSLKGLAKELDVPVIALSQLNRSLEQRPNKRPVMSDLRECVTGDTRVLLADGQRVPIRDLVGQTPEVISVNAEGRLEPAKTDLVWSVGVRPLLQVRLASGRTIRCTPEHRLRGLWDWKEARDIRVGDRLGIARELPAPKVTKRWAEHELVLLAHLVGDGSYIKGQPLRYTTASEANSEAVSRAAEAMGSTVTRHPGRGQWHQLVISGNGNRWHPQGVGKWLKQLGVFGQRSREKHLPQEVFQLDNDQLALFLRHLWATDGSITQGSAGRPRIYFSTASRHLIQDVAALLLRFGIVGRTKHITHGDGEGWFTLDISGAVQQQRYLEKIGAFGHQAHNARRALQHLRGLVENTNVDTLPEEVFNYIRERMREEGITHRQMAALRGTAYGGSAHFTFSPSRETLLSYADILNDQRLRMLANQHVFWDRVVSVEPAGEEEVFDLTVPGNACWLADGIVSHNSGAIEQDADVIVFIYRDEVYNPDTPEKGVAEIIIGKQRNGPIGTVKLTFLGRFTRFENHIEEYYPGGGLPE

SEQ ID NO: 959 - protein, 71 aa, Alkalilimnicola ehrlichei MLHE-1
  Aeh DnaB-2 C-extein
SGAIEQDADVIVFIYRDEVYNPDTPEKGVAEIIIGKQRNGPIGTVKLTFLGRFTRFENHIEEYYPGGGLPE

SEQ ID NO: 960 - protein, 393 aa, Alkalilimnicola ehrlichei MLHE-1
  Aeh Rir1 C-extein
CGEQPLPPYGACLLGSVNLTKFVRDPFTEKARFDWQEYAEVVSVFTRMLDNVVEINGLPLDEQRREIERKRRHGMGFLGLGSTLTMLRMKYGEAESLAFTEKVSREMALAGWRTGVELAEEKGPAPIMDETYTVDEAMLAKRPEMAVDGYKVGDKVKGRVLLARYSHYMQRVAEVDAELVEAIAEKGARFSHHTSIAPTGTISLSLANNASNGIEPSFAHHYFRNVIREGRKSKEKVDVFSFELLAYRHFIDPEAVPSTDPETRNLPDYFITADSVTPKQHVDIQAAAQKWVDSSISKTANVPTDYPYEDFKDIYRYAYQQGLKGCTTFRFNPEAFQGVLVTEKDLTNTFYKFKLADGTEVELRGDEEVEYDGETHTAANLYDALKEGYYGKF

SEQ ID NO: 961 - protein, 79 aa, Acyrthosiphon pisum secondary endosymbiot phage 1
  AP-APSE1 dpol C-extein
CENICQAAARDVLAYNMPPIEKAGYEIVLTVHDEIISEAPDTPQFSAEGLSKLLSFNSDWAWDLPLSANGFETYRYRKE

SEQ ID NO: 962 - protein, 83 aa, Aeropyrum pernix K1
  Ape APE0745 C-extein
SAFGWGLEHVADGIIRFRRRIVGGALRRYVVVEKMRQTPHDLRVHRVEIEDGRGMRIAGPLEARPEDLRMPEDLRRRLKGGGP

SEQ ID NO: 963 - protein, 337 aa, Acanthomoeba polyphaga Mimivirus
  APMV Pol C-extein
TDSIFINFHIKDENGEEKTDKEALMKTIAKCQRAAKLINQNVPKPQSIVYEKTLHPFILVAKKKYVGLLFEKSPDKYFLKSMGIVLKRRDNAPIVKIVVGGIIDNILKNRDIDKAIEYTKIVLDKLMNGEYPMDKFIISKTLKSRYKKPSTIAHKVLADRMAVRDPGNKPQINDRIPFVYIVKDMGKKKKKDILQGDLIEHPEYVIANNLKIDYLYYLEHQIINPASQILELMMDTKDVQKFFNKYIIDEQNKRKGAQSLTKWMDFSKLPKESGSKTAKKPYQSQKLQKTKSSNKSQIDPKYINLIKNKSRKHECQNMNKWISSTDKCTDDWEPIVE

SEQ ID NO: 964 - protein, 234 aa, Burkholderia cenocepacia
  Bce DnaB C-extein
TAFSMNIGEYVAVEYGLPVAVFSMEMPGTQLVMRMLGSIGRLDQHRMRTGRLTDEDWPKLTHAVQKMSEAQLFIDETGGLNPMELRSRARRLARQCGKLGLIIVDYLQLMSGSSQGENRATEISEISRSLKSLAKELDVPVIALSQLNRGLEQRPNKRPVMSDLRESGAIEQDADVILFIYRDEVYNPDSPDKGTAEIIIGKQRNGPIGPVRLTFLGQYTKFDNFAGAQTFYGE

SEQ ID NO: 965 - protein, 594 aa, Batrachochytrium dendrobatidis JEL197
  Bde-JEL197 RPB2 C-extein
CPAETPEGQACGLVKNLSLMGYITVGSPAPPILEFLEEWTMESLEEISPSTIPTATKIFLNGQWVGIHRDPDQLVSTLRRLRRSVDVSPEVSVVRDVRDRELRLCTDAGRIARSLFVVTPEQSLVLTKEMVQQLHEDQIQWKDLLSYGVVEYIDTEEEETVMICMTPDDLAEARMAAAGQVVERHQVGTGRLKSATVYTRNYTHCEIHPSMILGICASIIPFPDHNQSPRSVYQSAMGKQAMGLFLTNFQLRMDTMSNILFYPQKPLATTRAMEFMHFRDLPAGINAVVAIACYSGYNQEDSLIMNQSSIDRGLFRSLYYRVYMDQEKKVGMISTETLEKPSRDTTLRLKHGTYEKLEDDGLIAPGVRVSGEDIIIGKTVPIAADSTELGQRTTMHTKRDASTPLKSTENGIVDQVLITTNQDGFKFVKVRVRSIRIPHMGDKFASRHGQKGTVGITYRTEDMPFTADGITPDLIINPHAIPSRMTIGHLVECLLSKVSTFTGDEGDATPFTDVTVEAISQALQGYGYQRRGFEVLYNGHTGRKLNAQVYTGPTYYQRLKHMVDDKIHSRARGPLQILTRQPVEGRSRDGGLRF

SEQ ID NO: 966 - protein, 59 aa, B.subtilis M1918 (prophage)
  BsuP-M1918 RIR1 C-extein
CSEVLQSSQVSVYTDYDKEDEIGLDISCNLGSMNIVNVMSNQSIASTVRIAIDSLTTVT

SEQ ID NO: 967 - protein, 319 aa, B.subtilis strain 168 Sp beta c2 prophage
  BsuP-SPBc2 RIR1 C-extein
CSEVLQSSQVSVYTDYDKEDEIGLDISCNLGSMNIVNVMSNQSIASTVRIAIDSLTTVTRKTNIVNAPAVARANTLMRSIGLGQMNLHGFLAQNNIAYESEEAKDFANTYFMMVNFYSLQRSMEIARETGETYYKFDGSTYKSGEYFEKYVTNDYSPQYEKVKKLFGDQHIPNIQDWMKLKEDVMKYGLYHSYRQAIAPTGSISYVQSSTAGVMPIMERIEERTYGNSKTYYPMPGLSAQNWFFYKEAYDMDMFKVVDLIATIQQHVDQGISFTLFLKDTMTTRDLNRIDLYAHHRGIKTLYYARTKDTTQEGCLSCVV

SEQ ID NO: 968 - protein, 315 aa, Clostridium botulinum phage C-St
  CbP-C-St RNR C-extein
CRLTSSSKEISENKEVAELNGHFNSIGGSSLSIGSCKVNTINMVRIALECNGDFNKFKDILKHRVDISHKYLKVQRDVIAKNIKKNLLPVYSHGLMDMNNQFSTIGINGMFEAIKILGGIETTSTGVHYTDRGLSMAKDILETIGEMNKVTRKQYGYNANIEQIPAESASVKLCKKDKILFGDRVNTYIYGNQWIPLNVQADLTERVRVASVLDKACGGGVMLHINLGERFKDEEQSWRMMNYLAKQGVVYFSFIMKINVCENDHSFYGDMCPICHKPVSDSYVKIVGYLVKQSSYKSERAKEMDERKFYSNYNI

SEQ ID NO: 969 - protein, 315 aa, Clostridium botulinum phage D
  CbP-D RNR C-extein
CRLTSSSKEISENKEVAELNGHFNSIGGSSLSIGSCKVNTINMVRIALECNGDFNKFKDILKHRVDISHKYLKVQRDVIAKNIKKNLLPLYSHGLMDMNNQFSTIGINGMFEAIKILGGIETTSTGVHYTDRGLSMAKDILETIGEMNKVTRKQYGYNANIEQIPAESASVKLCKKDKILFGDRVNTYIYGNQWIPLNVQADLTERVRVASVLDKACGGGVMLHINLGERFKDEEQSWRMMNYLAKQGVVYFSFIMKINVCENDHSFYGDMCPICHKPVSDSYVKIVGYLVKQSSYKSERAKEMDERKFYSNYNI

SEQ ID NO: 970 - protein, 75 aa, Coxiella burnetii
  Cbu DnaB C-extein
SGAIEQDADLIAFIYRDEVYHEDSPDKGKAEIIIAKHRNGPIGKVILTFRGQYTRFDNFSHESVPQRMPFGGVPV

SEQ ID NO: 971 - protein, 690 aa, Chlorobium chlorochromatii CaD3
  Cch RIR1 C-extein
CSEYMFLDDTACNLASLNLIHFVDEASGTIKINELRHAASLWTVVLEISVLMAHFPSQTIARLSYDFRTLGLGFANLGTVLMVLGIPYDSAEALAMAGAIASLMTGQAYVTSAEMARDLGTFKRYSDNANDMLRVMRNHRRAAQNAATTDYEGLSVIPHGINAAHCQTALAEAAGAVWNEVLQKGEAHGFRNAQVSVIAPTGTIGLVMDCDTTGIEPEFAIVKFKKLAGGGYFKIVNQSVHKALLRLGYSAEQIEDIERYCKGHGTLEGCPAINGEWLKCKGFTEEKIAAVESQLATVFDIRFAFNKWILGEEFCASLGFSEEQLDNPDFDMLLELGATTAEAAAANDYICGTMMIEGAPHLQPEHLAVFDCASKCGKKGKRYIRHQAHINMMAAVQPFISGAISKTVNMPATATTAEIGNVYRDAWQQMVKAVTIYRDGSKLSQPLNSSSYNDLDEVIMLGTEETLDETKGPQEVQERIIERVYYRSERRMLPKRRKGYIREAYVGGHKVFLRTGEYDDGTLGEIFIDMYKEGASFKGLLNCFAVLASKALQYGMPLEELVDSFTFTRFDPAGTVQGHNVIKNSTSILDYVFRSIGYDYLGRKDFVHVKAVDEVPEGTLVPAEQKKASHHSAANHSTDGAGVVSNKSQIYQAKVQGYTGEQCENCGSMHVKQNGTCKVCEDCGMTTGCS

SEQ ID NO: 972 - protein, 107 aa, Chlamydomonas eugametos (chloroplast)
  Ceu ClpP C-extein
SSIQGQASDIWIDSQEIMKIRLDVAEIYSLATYRPRHKILRDLDRDFYLTATETIHYGLADEIASNEVMQEIIEMTSKVWDYHDTKQQRLLESRDSTTSGADTQSQN

SEQ ID NO: 973 - protein, 301 aa, Candida glabrata
  Cgl VMA C-extein
CGERGNEMAEVLMEFPELYTEMSGRKEPIMKRTTLVANTSNMPVAAREASIYTGITLAEYFRDQGKNVSMIADSSSRWAEALREISGRLGEMPADQGFPAYLGAKLASFYERAGKSVTLGSPNRVGSVSIVAAVSPAGGDFSDPVTTATLGITQVFWGLDKKLGQRKHFPSINTSVSYSKYTNVLNKFYDSNYPEFPTLRDRMKEILSNAEELEQVVQLVGKSALSDSDKITLDVAALIKEEFLQQNGYSTYDAFCPIWKNFDMMRSFIAYHDKAQKAVSNGANWNKLSEAVSDVKHSVSS

SEQ ID NO: 974 - protein, 349 aa, Chilo iridescent virus
  CIV RIR1 C-extein
CSEIILPTDSTRTAVCCLSSLNLEYYDEWKDNDLFIKDVMEMLDNALTIFIEKAPPTISRAVNSAKKERSIGIGVLGFHSFLQQKNISFESDEAAKLNIDIFTKLRSKIDTFNLVLGSLRGSPEDAEGTGRRFCCTMAVAPTATSSIIMGNTSPSVEPFRANAYRQDTLSGSFLNKNRYLSRILSQRLNVKEINEVWSNIVSNGGSVQQLPNNLLSEQEKQVFKTAFEINQKWVIKHAADRQKYIDQSQSINLFLKPDIHKRELHSLHLNAWKSGLKTLYYLRSEKIADADKISSNHMINSINFTNIKESIKDSIKVSILEVRNKEKNYEEKICKLTNGRRLSGCFACE

SEQ ID NO: 975 - protein, 15 aa, Cryptococcus laurentii strain CBS139
  Cla PRP8 C-extein
SGFEESMKFKKLTNA

SEQ ID NO: 976 - protein, 10 aa, Filobasidiella neoformans (Cryptococcus neoformans) Serotype A, PHLS_8104
  Cne-A PRP8 (Fne-A PRP8) C-extein
SGFEESMKNK

SEQ ID NO: 977 - protein, 17 aa, Cryptococcus neoformans (Filobasidiella neoformans), Serotype AD, CBS132).
  Cne-AD PRP8 (Fne-AD PRP8) C-extein
SGFEESMKNKRLTNAQR

SEQ ID NO: 978 - protein, 830 aa, Cryptococcus neoformans var. neoformans JEC21
  Cne-JEC21 PRP8 C-extein
SGFEESMKNKRLTNAQRSGLSQIPNRRFTMWWSPTINRANVYVGFQVQLDLTGVFMHGKIPTLKISLIQIFRAHLWQKIHESVVMDLCQVFDQEMEALQIETVQKETIHPRKSYKMNSSASDILLFSSYKWQISRPSLLTDNRDTMDGTTSNKFWLDIQLRWGDFDSHDIERYARAKYLDYSSDSQSIYPSPTGNLIAIDLAYNLYSAYGCYFPGLKPLLQQAMAKIMKANPALYVLRERIRKGLQLYSSEPTEPYLNSSNYSELFSNQIIWFVDDTNVYRVTVHKTFEGNLTTKPINGAIFIFNPRTGQLFLKIIHTSVWAGQKRLGQLAKWKTAEEVAALVRSLPVEEQPKQVIVTRKGMLDPLEVHLLDFPNIVIKGSELQLPFQATLKMEKFGDLILRATQPQMVLFNLYDDWLKSISSYTAFSRLILILRALHVNNEKSKIILRPDKNTITESYHIWPSLSDDEWMKVEVALKDLILADFGKRNSVNVASLTASEIRDIILGMEIAAPSVQRQQMAEIEKNTEAAAQVTALQTKTTNIHGDEIVVTTTTQYEQQTFASKSDWRVRAISATNLPLRVNHIFVGNDDVKDDAGSYTYVIPKNVLRSFIVNADLRTQVVAYLYGTSPPDNKQVKEIKAVAWIPQRGTNNGVDLPVTLPKHDFLLKDLEPLGWIKTQSQELNHLSPQDVTTQAKIMAAHPEWGPQSICVTCSFTPGSVSLNAWDLTVAGFEWGRKNEDVTGQNPGFNPSMANRVQLLLSDRILGMTLVPEGGIWNYGVGLTQSWSEKIPYTMTLDKPEAFWAPCHRPNAFLNFASMEGDDAADVENSLE

SEQ ID NO: 979 - protein, 449 aa, Clostridium thermocellum
  Cth TerA C-extein
SELAAAVALYMTCGDGEWGAEVYGCAADRQQASIVFDVAVEMVEQCPALKKRIKPVLSVKRLIYKPTNSFYQVLSAEAYSKHGLNVHGVVMDELHAQPNRDLYDVMTKGSGDARLQPLFFLITTAGTDRNSICYEVHQKAVDILEGRKIDPTFYPVIYGIDDNDDWTLEKNWYKANPSLGHTIDIEKVRNAFNSAKENPAEENIFRQLRLNQWVKQSTRWMQMDKWDECAFKVDIDSLKGRECYGGLDLSSTTDITAFVLVFPPRTSDEKYIVLPHFWIPEDNLNLRVRRDHVPYDIWKKQGYLKTTEGNVVHYGYIETFIEELGKKYNIKEIAFDRWGAVQMVQNLEGMGFTVVPFGQGYKDMSPPTKELMKITLEKKIAHGGHPVLRWMMDNIYVKTDPAGNIKPDKEKSTEKIDGAVALIMALDRSIRHENKESVYEKRGMRSFLD

SEQ ID NO: 980 - protein, 334 aa, Candida tropicalis (nucleus)
  Ctr VMA C-extein
CGERGNEMAEVLMEFPELFTEISGRKEPIMKRTTLVANTSNMPVAAREASIYTGITLAEYFRDQGKNVSMIADSSSRWAEALREISGRLGEMPADQGFPAYLGAKLASFYERAGKATALGSPDRVGSVSIVAAVSPAGGDFSDPVTTSTLGITQVFWGLDKKLAQRKHFPSINTSVSYSKYTNVLNKYYDSNYPEFPQLRDKIREILSNAEELEQVVQLVGKSALSDSDKITLDVATLIKEDFLQQNGYSSYDAFCPIWKTFDMMRAFISYYDEAQKAIANGAQWSKLAESTSDVKHAVSSAKFFEPSRGQKEGEKEFGDLLTTISERFAEASE

SEQ ID NO: 981 - protein, 331 aa, Chlorella virus NY2A infects Chlorella NC64A, which infects Paramecium bursaria
  CV-NY2A RIR1 C-extein
CNEIVEYTSKEETAVCVIGSVVLKNYVKNDKFDFDDLRKNVKILAKNLDRSIDVMAYPIKEAETSNKLRRPIGVGVQGLQDVFFKLRFSYDSPEARDLNREIFEHIYYAAVEASVELAEIHGPYPTFEGSPASKGILQYHLWDVTPKSNLDWRGLEERVKKGIRNSLVTALMPTASTAQICGSVEAFEPITSNLYSRRTLAGEFPVINSYLVRELIERGTWNEQMKNQIIANGGSIQKVIGIHPSVKAVYKTAWDLSMKSVIDMASDRGAFVDQTQSMNLFLAQPTLKNVTSMLFYGWKSGLKTLQYYLRSKPASSAIAVTIDNDCLVCSA

SEQ ID NO: 982 - protein, 375 aa, Crocosphaera watsonii WH 8501 (Synechocystis sp. WH 8501)
  Cwa PEP C-extein
CHAAIIAREMGIPAIVGCGDATDKIKTRQEITVCCSEGEKGRVYDGLLPFEVEETPLDNLPVTRTQILMNVGNPEKAFSLANIPAQGVGLARLEFIIANHIKAHPLALMKFDELEDEAVKEQIAELTKRYDNKPQFFVDKLAHGVATIAASFYPKPVIVRMSDFKSNEYANLLGGQGFEPKEDNPMIGWRGASRYYDPMYREAFALECQAMKTVRDDMGLVNVIPMIPFCRTPEEGKKVIAEMAKNGLKQGVNGLQIYVMCELPSNVILADQFADVFDGFSIGSNDLTQLTLGLDRDSALVAQLFDERNEGVKRMVKLAIETAKKKGRKIGICGQAPSDYPEFAKFLVELGIDSMSLNPDSVLKTLLMVAEVEKG

SEQ ID NO: 983 - protein, 306 aa, Crocosphaera watsonii WH 8501 (Synechocystis sp. WH 8501)
  Cwa RIR1 C-extein
CTESFSNVTPGKFAHCCNLVSLNLANIEEEELDYLCNISVRILDNTIDITNPPFNDAKAHNDRYRTVGVGCMGLADWLAKKGLTYENITEISNLFEEVGYWCTHTSMELAKERSPYNAFEGSDWSKGLLIGSKPVDWFVENASKKERWVQLSEDIKTYGIRNSHITAIAPNTSSSLVQGCTASILPVYSRFFYDKWAKGTIPIAPPFIKESFWFYHENKTLEQQKVVKAVATIQQWIDTGISMELLFNLNQGVYFADEPERCLTAKDIFETLLLAWKEGCKAIYYVRTVQKDDFKESDNNCTACAN

SEQ ID NO: 984 - protein, 78 aa, Costelytra zealandica iridescent virus
  CZIV RIR1 C-extein
CSEIILPTDENRTAVCCLASLNLDYYDNWCDNEQFYLDVATYLDNVLQYFIDNAPRSLKRAIYSAESERAIGIGVMGL

SEQ ID NO: 985 - protein, 639 aa, Dictyostelium discoideum strain AX4 (nucleus)
  Ddi RPC2 C-extein
CGLVKNFALMSHVTTDDSEGPLLRLAYNLGVQDILLVTGEELNSRNAYLVLLNGQIIGIHNSPDYFVTTLRKMRRAGRIREFVSICKNKAQQTISVACDGGRLCRPVIIVDDQRPRLTQEHIEDLKDGLRTFDDFIREGIIEYLDVNEENDSFLAWREAAIQPWTTHLEIEPFTMLGCVAGLIPYPHHNQSPRNTYQCAMGKQAIGAIAYNQLTRIDTLLYLLVHTQRPLCQTRTIDLLNWYKLPAGHNATVAVMSYSGYDIEDALVMNKASLDRGFGRCIVLKKQVTSIKKHGNDTSDRIFPPTPNDLRQPKYGLLDSDGIAKPGELAQKGQILVNKYSPLNTIDATPNPELIPDSAYKSSYMGYKYDNPAFIDKVLLTSGDDEQLLIKMLMRSTRRPELGDKFSSRHGQKGVCGIIVKQEDMPFSDLGICPDIIMNPHGFPSRMTIGKMIELLAGKAGVLSGKFGFGTCFGGDRVENISKVLISKGFSYGGKDYVTSGVTGEPLACFIFFGPIFYQKLKHMVMDKMHARARGPTVTLTRQPTEGRARGGGLRLGEMERDCLIGYGASALIMERLMISSDRFTVYACKNCGFLGYEGYCQYCKSSVDISTIQIPYACKLLFQELQAMNIVPRLKLVDS

SEQ ID NO: 986 - protein, 233 aa, Deinococcus geothermalis DSM11300
  Dge DnaB C-extein
TAFALSIAQNVALRGEKTVAVFSLEMPAVQLALRMLCSEARVDMNRIRSGQLNERDFERLAHAAGRLADAPMIIDDEPDLTLNALRSKLRRIAAQHGQLGLVVIDYLQLMSGGKNSGGSDNRQQEISTISRGLKGLAREMEVPIIVLSQLSRAVEQRPNHRPMLSDLRESGAIEQDADIVMFIYRDEYYNKETDQQGIAEIIIGKQRNGPVGTVKLQFHSAHVRFNDLAPEGV

SEQ ID NO: 987 - protein, 504 aa, Desulfitobacterium hafniense DCB-2
  Dha-DCB2 RIR1 C-extein
CGEQPLLPNEACNLGSINLKLMVTEKNGKVVVDWERLGQITRLATRFLDNVIEANTYPLPSIEEMVKGNRKIGLGVMGFADMLILLQTSYASEDAVEYAEKVMNFIQTEARLESQRLAEERGTFPNYQGSIYDGVRPLRNATLTTIAPTGTISMICGASSGVEPLFAVAYTKTVMDGTPLIEVNPIFQSLAEDYGFNSPELMRKIAEKGTVLGFPEVPNWVQEVFVTAQEIEPEWHIRIQAAFQKYTDNAVSKTINFANEATHEDIAKAYELAHELNCKGLTVYRDGSREEQVLSTGITKKAEEKAEEAKTQVSIPKVPFIPEVNTVLPRPRPTTTTGVTEKIRIGCGNLYVSVMADEKGICEIFTNTGRAGGCSSQSEATARLISIALRSGISVDAIIEQVKGIRCPACIRREGVNVTSCPDAIARVIKEYVELGKGKVNSVKVTSQPAVEEKPVQSKSASITNPQKTRATVAEGNACPECGMSINHESGCVVCTHCGYSKCG

SEQ ID NO: 988 - protein, 504 aa, Desulfitobacterium hafniense Y51; identical to SEQ ID NO: 987
  Dha-Y51 RIR1 C-extein

SEQ ID NO: 989 - protein, 948 aa, Debaryomyces hansenii CBS767
  Dhan GLT1 C-extein
CHLNTCPVGIATQDPELRKKFTGTPEHVINFFYYLANELRGIMANLGFRTVNEMIGRTEKLKVREDLRNTKNANMDLSPILTPAHTIRPGVATHCVKKQDHRLHVRIDNKLIDESEITLAKGLPVTIDCDVVNTDRSLGTTLSYRVSKTFGEQGLPHDTIHVNVNGSAGQSFGAFLAPGITLELEGDANDYVGKGLSGGRIIVYPPKESKFNAEDQIIAGNTAFFGATSGAAFIRGIAAERFAVRNSGANIVVEGTGDHGCEYMSGGRVVVLGSTGRNFAAGMCGGIAYVLDMAQDFGDKVNSQNVELSQITEASEIAFVRGLIEDHRHYTSSAVAENILNNFDRILPRFVKVLPYDYEKVLENEKKKQEEAKKNELNTFIKSIKEDPESDATNGEAAKIRKGHIHRPSLATVSAKDCSHEPNVLDLEDTIFDTEVEKKSVAKLDKLKGFMKYKRRNEKYRDAKKRTNDWNEMTSRLTKDELKYETARCMDCGVPFCTSDTGCPISNVIPKWNELVFQDRWYDALQRLLMTNNFPEFTGRICPAPCNGACVLGINSDPVNIKSVECAIIDHGFEQGWIKPEPPQHRTGKSIAVIGSGPAGLATADQLNKAGHSVKVYERSDRPGGLLMYGIPNMKLDKRIVKRRTDLMTAEGVEFICSTTIGEDISIEEIRSSNDAVVFAVGSTIPRDLRIKGRELNNINFAMQLLHKNTKALLDNDLEEIKKTLEGKHVIVIGGGDTGNDCLGTSTRHGAKSVTNFELLPNPPTSRPKDNPWPQWPRVFRVDYGHTEVTEHYGKDPREYSILSKEFVDDGEGNVKGIKTIRVEWKRSDSGAWQMAEVPGSEEFFSADVVLLSMGFVGPDADNLEVTKTKRGTISTVEPNGYKVSNEDNLFTAGDCRRGQSLVVWGIQEGRQCAREVDNYLMGSSRLPGNGSIEQRNFKLLEELAEKV

SEQ ID NO: 990 - protein, 334 aa, Debaryomyces hansenii CBS767
  Dhan VMA C-extein
CGERGNEMAEVLMEFPELYTEINGRQEPIMKRTTLVANTSNMPVAAREASIYTGITLAEYFRDQGKHVSMIADSSSRWAEALRELSGRLGEMPADQGFPAYLGAKLASFYERAGKAVALGSPDRIGSVSIVAAVSPAGGDFSDPVTTATLGITQVFWGLDKKLAQRKHFPSVNTSISYSKYTNILDKYYESNYPEFPALRNKLKEILSTAEELEQVVQLVGKSALSDSDKITLDVANLIKEDFLQQNGYSTYDQFCPIWKTFDMMRAFTSYHDEAQKAVANGAQWGKLSEATSDVKHAVSSSKFVEPSEGEEKGKKAFNELLANISEKFAEASE

SEQ ID NO: 991 - protein, 110 aa, Desulfovibrio vulgaris subsp. vulgaris DP4
  Dvul ParB C-extein
CWYAVKGQAHWSGDRKQVTVWNIASKGQDAETIHGTQKPVECMKRPMENNSSPGQAVYEPFSGSGTTIMAAELTGRCCYAMELNPAYVDVAVTRWENFTGQKAMRELPHV

SEQ ID NO: 992 - protein, 829 aa, Emericella nidulans (anamorph: Aspergillus nidulans) FGSC A4
  Eni-FGSCA4 PRP8 C-extein
SGFEESMKFKKLTNAQRSGLNQIPNRRFTLWWSPTINRANVYVGFQVQLDLTGIFLHGKIPTLKISLIQIFRAHLWQKIHESVVMDLCQVFDQELEQLGIEAVQKETIHPRKSYKMNSSCADILLFATNKWNVTRPSILFDTKDVYEPTTTNKFWLDVQLRYGDYDSHDIERYVRAKYLDYTTDSMSIYPSATGLMIAIDLAYNLYSAYGQYFPGLKTLIQQAMAKIMKANPALYVLRERIRKGLQLYASESNQEFLNSQNYSELFSPQIQLFIDDTNVYRVTIHKTFEGNLTTKPINGAIFIFNPRTGQLFLKIIHTSVWAGQKRLGQLAKWKTAEEVAALIRSLPVEEQPKQLIVTRKGLLDPLEVHLLDFPNISIRASELQLPFQAAMKVEKLADMILRATEPQMVLFNLYDEWLKTISPYTAFSRLILILRALHVNIDKAKIILRPDKSVITLEHHIWPSLSDEDWMKVEVQLRDLILNDYGKKNNVNVQSLTSSEVRDIILGMEISAPSLQRQQAAEIEKQQEEAKQLTAVTTKTQNVRGEDIIVTTTSQYEQQSFASKTEWRTRAIATSNLRTRANNIYVSSDDIRDEGYTYIMPKNILKRFIMIADLRVQVAGFLYGSSPPDNDQVKEIRTIVMVPQVGNTREVQLPQQLPQHDYLNSLEPLGVIHTISGNEPPYMTAQDVTQHSRLMNAHSSWDKKTVTMTVSFTPGSVSLAAWGLTPQGYKWGAENRDTTSDQPQGFSTSMGEKCQLLLSDKIRGYFLVPEDNVWNYSFMGSSYGSVEKRPVYVKIDTPLRFYDDQHRPLHFQNFAELEDIWVDRSDNFA

SEQ ID NO: 993 - protein, 63 aa, Ferroplasma acidarmanus, taxon:97393 and taxon 261390
  Fac-Fer1 RIR1 C-extein
CGEQPLLPYESCNLGSINLAKFVEDGKFTMTGIGKHCVAQILKCVKHNPVDTHIAATGIAGYG

SEQ ID NO: 994 - protein, 237 aa, Ferroplasma acidarmanus
  Fac-Fer1 SufB (Fac Pps1) C-extein
CTAPKYNTSSLHTAIVEIYARKNSDVKYTSVQNWSDSVYNLPVKRAWVDENAHMDWVTGELGSKVTMIYPSSYLRGRGASTSNLQITLATKDTFKDAGGKALHLAPDTTSRIVSKSISLDNGLTAYRGLVRMNEGAKRAKSHVQCDALLINSDSKNYTYPYDEIYEPTAEFSHEATVGKIGTDELTYLRSRGLSEDEASSMIVLGFMDDIMKEIPMEFAVEMNRLVKLEMSKMGAVG

SEQ ID NO: 995 - protein, 226 aa, Frankia alni ACN14a
  Fal DnaB C-extein
STLGLDFARAASIKNGLTSVIFSLEMSRMEITMRLLSAEARVSLQNIRTGRLTDDDWARLARRMGEVAEAPLFIDDSPHLTMMEIRAKARRLKQRNELRLVILDYLQLMSSPKKVESRQQEVSEISRSLKLLAKELDVPVVAISQLNRASEQRADKRPQVSDLRESGSLEQDADAVILLYREDTVEKESARAGEADLIIAKHRNGPTGTVTVAFQGHYSRFVDMAN

SEQ ID NO: 996 - protein, 63 aa, Guillardia theta (plastid)
  Gth DnaB C-extein
SIEQDADVVLFLYRDSYYQHNLKQSNIDMCEVIVAKHRHGTIGMVNLIFNPNTVSFMNLIKES

SEQ ID NO: 997 - protein, 230 aa, Gloeobacter violaceus, PCC 7421
  Gvi DnaB C-extein
TAFSLSIAQRIAQKAGLPAVVFSLEMSKEQLVQRLLCSEAGVESHRLRAARISENEWQRIGQAIGELASIPLYIDDSPNATVTEIRSKARRLQAEQGGRLGLVMIDYLQLMEGAGSDNRVQELSKITRGLKGLARELRVPVMALSQLSRSVEARTNKRPMLSDLRESGSIEQDADIVLMLYRDDYYNPDSPDRNIAEVNIVKHRNGPTGTVKLLFENQFTRFLNLTSGNH

SEQ ID NO: 998 - protein, 444 aa, Gloeobacter violaceus, PCC 7421
  Gvi RIR1-2 C-extein
CGEIWLPPNSACNLGSIVISKFMHRTERGVELDWEDLARTVEISTRFLDNVLDVAEFATPAQKHNVRNVFRQLGLGIMGWADWLKARRIPYDSEAHLREIDKVGRFIAERAYRTSEALAAEKGACGIWEEIKDVRPGNPFERWRDSTGRVLSGDEAAERAEALTQTPRRNSTVLSIAPTGSIAQLASCSWAFEPDFGLTIWKQVYVDASSSQQNWVQIPSPYVEALGLGEADRQIVLQTGSLQGTAFAAAHPEEAAAFKISREISWQWHVLAQSRWQNWVDSSISKTINCSRETTVEEIKEMYRFAQRNGLKGITVYREGTLESEPVKIGAIDQNEPAAAAQPVAPTADGNGNGYVPARPFATGAARPAMLDEEVSQAASLIGIHYDEGPMYLSEEAPVDDWTSSQFKGGCGGGVLHYQVWIRENGRRLLVVRSDSYSMCFVKS

SEQ ID NO: 999 - protein, 266 aa, Heterosigma akashiwo virus 01
  HaV01 Pol C-extein
TDSVYVNFPSTNNDMQKVFDISIEAAEAISKTFPQPIELEFEKVMYPFILFTKKRYASLIWTRVDKPDKIDFKGIQVVRRDNCSYVRESLTTIYNCLLYERNVDKCLGITDKIIDDLLKGRVPIEKLTVSKSLKSNYKSKTMPHFLLAEKMKQRDPMNYPRPGERVPYVFIENTEARLQGEKAENPEYAKENGLIIDTLYYLDHQMKKPLAELFNIVLGEGKYNLYKNHMGFIKMKKNHQERERLREINRKKGQKELNLKWFSKKK

SEQ ID NO: 1000 - protein, 381 aa, Halorhodospira halophila SL1
  Hhal DnaB-1 C-extein
TTVAMNMVEHVAMQLKKPVAVFSMEMPADALAMRMLASLGRVHLQRVRSGKLQDDDWPRLTSTMSLLAEAPLFIDDSPGLTPTEIRARARRLQREHDELGLIVIDYLQLMQIPGFRENRAGELSEISRGLKALAKELNTPVIALSQLNRSLEQRPNKRPIMSDLRECVTGDTLVLLADGQRRPISELVGSAPEVIAIDDRHRLVPAQAERVWRVGRRPVYRVQLASGRLLRATARHRLLTGSGWKRVDELRDEDRIAIARTVPEPGSVMESESDVFWDHLVAVEPDGEEDVYDLTVPGPASWVADSIISHNSGAIEQDADLIAFIYRDEVYNEDTPDKGVAELIIAKQRQGPIGTVKLTFLGEYTRFENYIEDVYGGGIPG

SEQ ID NO: 1001 - protein, 367 aa, Haloarcula marismortui ATCC 43049
  Hma CDC21 C-extein
SQMLSYIENIAPRSVYTSGKGSSSAGLTAAAVRDDFGDGQQWTLEAGALVLADQGIAAIDELDKMSPEDRSAMHEALEQQRISVSKAGINATLKSRCSLLGAANPKYGRFDQYEPIGEQIDLEPALISRFDLIFTVTDKPDEEKDRNLAEHIIQTNYAGELHTHRTENPTSNFSEEEVGTVTEEVAPTIEPDLLRKYVAYAKRNCFPTMTEEAKSRIEDFYVDLRLKGQDEDAPVPVTARKLEALVRLAEASARIRLSDTVDEADADRAVDIAHYCLKEIGVDPETGEFDADVVETGQSKTQRDRIQNIKGIISDIEDEYDEGAPADVVIERAEEVGIDESKAEHEIDKLKQKGEVYEPRTDHLRTT

SEQ ID NO: 1002 - protein, 250 aa, Haloarcula marismortui ATCC 43049
  Hma Pol-II C-extein
CDGDEDCVMLLMDGLLNFSKSYLPNQRGGQMDAPLVMSSRIDPSEIDDEAHNMDIMDAYPREFYEATREMKDPTEVEDVMKIAEETLGTDREYTEFRHTHDTANIAAGPDLSAYKTLGSMEDKMDAQLEISRKLRAVVESDVAERIIEYHFLPDLIGNLRAFSRQEVRCLDCGESFRRAPLTGDCRECGGRVNLTVHEGSVNKYIDTAIRVADEFGARDYTKQRLKILERKIESVFENDHNKQSGIADFM

SEQ ID NO: 1003 - protein, 349 aa, Haloarcula marismortui ATCC 43049
  Hma PolB C-extein
SLYGVLGWDRFRLYDKEMGAAVTATGREVIDYTDEVVANEGYEVVYGDTDSVMLQLGNVGPDDVEGDVEITDEMREKHPEMDDDELELIATTIQKGFELEETINASYDEFAMERLNAQFHRFEIEFEKLYRRFFQAGKKKRYAGNIVWKEGKHVDDIDITGFEYQRSDIAPITKRVQKEVIDRIVRGEDAESIKQYVSDVIEDYQDGNVNYDDVGIPGGIGKKLDNYDTDTAQVRGAKYANMLLGTNFQSGSKPKRLYLDRVHSDFFQRIEEEEGLDPQRDPLYGEFRRDPDVICFEYADQIPEEFEIDWDKMLDKTLKGPIARILEAMDISWEEVKSGQEQTGLGSFM

SEQ ID NO: 1004 - protein, 334 aa, Haloarcula marismortui ATCC 43049
  Hma TopA C-extein
TRHNSIEKLYDRGYIEGDPPRPTTLAMAVVEAAEEFADHVVSDEMTAQLEADMTAIANGEATLDDVADESREMLKRVFDELRDSREEIGEHLQESLKADKTLGPCPKCGEDMLVRRSRQGSYFVGCDGFPECRNTLPLPSTGEPQVLEDHCEEHDMHHVKMLAGRDTFVHGCPRCEAEKADESEDEVIGPCPECGSEHDGDLAIKHLRSGSRLVGCTRYPDCDYSLPLPRNGDISVTEAFCEEHDLPELVIDADSDDPWELGCPICNYEEYQARTAIEDLEDLNGIGSATAEKLGDAGVDSLAALREADPDIVATEVQGVSATQVRDWQDELEA

SEQ ID NO: 1005 - protein, 367 aa, Halobacterium salinarum NRC-1
  Hsa-NRC1 CDC21 C-extein
SQMISYVQNIAPRSVYTSGKGSSAAGLTAAAVRDDFGDGQQWSLEAGALVLADNGVAAVDELDKMADDDRSAMHEALEQQKISVSKAGINATLKARCSLLGAANPKYGRFDQYEPIGEQIDLEPALISRFDLIFTVTDQPDPEEDAALADHILQTNYAGELNTQNEELANANYSEAEIESQTEDVAPAIEPGLLRKYIAYARRTCFPTMTPDARQAIEEFYVDLRSKGADEDAPVPVTARQLEAIVRLAEASARLRLSDSVEKSDADRVIGIVQSCLQDIGVDPETGEFDADVVETGQSKTQRDRVKNIKALIGEIEEEFDDGAPVEEVLDRAEEIGMDAGKAEHEIEKLKERGELYQPNTDHLRSI

SEQ ID NO: 1006 - protein, 250 aa, Halobacterium salinarum NRC-1
  Hsa-NRC1 Pol-II C-extein
CDGDEDCVMLLMDGLINFSKSYLPDKRGGRMDAPLVMSSRIDPAEIDDEAHNIDIDREYPREFYEATRELADPEDVADLITLAESTVGTDEEYTGFGHTHATSNIHLGPSLSAYKTLGSMMDKMDAQLELARKLRSVAETDVAERVIEYHFLPDLIGNLRAFSRQETRCLDCGEKYRRMPLSGDCRECGGRVNLTVHEGSVNKYMDTAMRVATEYDCREYTKQRLEIMDRRLESVFEDDTNKQSGISDFM

SEQ ID NO: 1007 - protein, 273 aa, Haloferax volcanii DS70
  Hvo PolB C-extein
TDSVMLELGPDVSKQEAIEQSFDIEEHINAAYDDFARDELGADEHRFQIEFEKLYRRFFQAGKKKRYAGHIVWKEGKDVDDIDITGFEYKRSDIAQITKEVQKNVIDMIVHGEETEVINDYLHDIITDFESGNLPLEQAGIPGGIGKRLSAYETPTAHVRGAQYANAFLGTNFGRGSKPKRVYLKKVHPSWFREMETGEFDPQVDDLYREFKRDPDVICFEYADQIPAAFEVDWDTMLTKTLEGPISRVIEALGMSWDEVKSGQEQTGLGSFM

SEQ ID NO: 1008 - protein, 204 aa, Haloquadratum walsbyi DSM 16790
  Hwa GyrB C-extein
SAKQGRERRFQAILPLKGKILNVEKHRLDRILENDEVRALITAIGAGIGDEFNVEDARYNRLIILSDADVDGAHIRTLLLTLLYRHMRPLVEAGYVYAAKPPLYRIRYNGNTYDAMTKSERDQVISDVCNGNPTQVQRFKGLGEMNPEQLWETTMNPENRVLKQITIEDAAAADKMFSVLMGDAVEPRKEFIKDRATDAEWVDI

SEQ ID NO: 1009 - protein, 1124 aa, Haloquadratum walsbyi DSM 16790
  Hwa MCM-2 C-extein
TAAAVRDDFGDGQQWTLEAGALVLADKGIAAVDELDKMRCVTGETLVSLADGRHVPIASLATDASKTGTIESKPDGVGRTIRGIDDLTVWTMTENKQLTGRPVTAIHQYDSPDTLWQITLSDGSEVTTTADHPFIIINRDGVHECPAKHLSENDEVYTPADGYTASTSDITPDSETSSDSLPDGGITQTRTNQYSSHRCDADLSDDELLDITTKTIKSIETVHPSDGTDVYDLTVSGTHNFVANGMIVHNSEDRSAMHEALEQQSYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHNSISVSKAGINATLKSRCSLLGAANPKYGRFDQYEPIGEQIDLEPALISRFDLIFTVTDEPDPDADAKLADHIINTNYAGELHTQKANIPNSEFTDGEVESATAEVTPTIDAELLRKYVAYARRNCYPTMTDDAQDVIRKFYVDFRAKGADDDAPVPVTARKLEALVRLSEASARLRLSDTVEQEDAKRVTSIVESCLRDIGMDPETGEFDADIVETGTSKNQRDRIKNLKHLIENIEADYDDGAPVDEVIEQAISELGLSESKAEGEIENLRAKGEVYEPRTGSLRTT

SEQ ID NO: 1010 - protein, 874 aa, Haloquadratum walsbyi DSM 16790
  Hwa MCM-3 C-extein
SEDRSAMHEALEQQSYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHNSISVSKAGINATLKSRCSLLGAANPKYGRFDQYEPIGEQIDLEPALISRFDLIFTVTDEPDPDADAKLADHIINTNYAGELHTQKANIPNSEFTDGEVESATAEVTPTIDAELLRKYVAYARRNCYPTMTDDAQDVIRKFYVDFRAKGADDDAPVPVTARKLEALVRLSEASARLRLSDTVEQEDAKRVTSIVESCLRDIGMDPETGEFDADIVETGTSKNQRDRIKNLKHLIENIEADYDDGAPVDEVIEQAISELGLSESKAEGEIENLRAKGEVYEPRTGSLRTT

SEQ ID NO: 1011 - protein, 288 aa, Haloquadratum walsbyi DSM 16790
  Hwa MCM-4 C-extein
SISVSKAGINATLKSRCSLLGAANPKYGRFDQYEPIGEQIDLEPALISRFDLIFTVTDEPDPDADAKLADHIINTNYAGELHTQKANIPNSEFTDGEVESATAEVTPTIDAELLRKYVAYARRNCYPTMTDDAQDVIRKFYVDFRAKGADDDAPVPVTARKLEALVRLSEASARLRLSDTVEQEDAKRVTSIVESCLRDIGMDPETGEFDADIVETGTSKNQRDRIKNLKHLIENIEADYDDGAPVDEVIEQAISELGLSESKAEGEIENLRAKGEVYEPRTGSLRTT

SEQ ID NO: 1012 - protein, 1672 aa, Haloquadratum walsbyi DSM 16790
  Hwa MCM-1 C-extein
SAMLQYIRNIAPRSVYTSGKGSSSAGLCVTGETRIHTTDGFVPLKQLATQHHPKKVTTETAAAYERELYTVDPTTQSAEVTQSKSSHVWRMPEKHCRRIRTASGKQLEASVNTPVLTVDDAEIKWKPISAIESNDSVVIPQYNNVERSSVSITDIFEFTQEQLKLTEKSITILRTEIVSQYQNIAAAADALNIDVNSVEALITGQPVVSDVIDRVCDAISVSSEDITIHHVIGPTGTAIELPEVLNDDLLYLLGAAFACGNIMTGETCEERWIQFHAPEESIRSHIIDAAVATFGSESIQTDTEQANTVQVISATVTRLFETLGLEQITDAAPREIHPRLTAVSGADAFIRGLFDTGGRIDNKNTPQIAIGTASEPLAEQIQLLLETYGIGSCRDTGDQSHTGTSTTQGQYLTLTGSDAQAYRTTIGTRTDSGSSWDRQVSSSHADSEPSVRSTTTDTRKRTDMHEHEIISAGDVSTVSSVESDGGTPQMPRSNIEPQSIGYDYESSRVNEIQTETVVEAVNTGKKEVFDLTVPNTQNFIGGGIVTHNTAAAVRDDFGDGQQWTLEAGALVLADKGIAAVDELDKMRCVTGETLVSLADGRHVPIASLATDASKTGTIESKPDGVGRTIRGIDDLTVWTMTENKQLTGRPVTAIHQYDSPDTLWQITLSDGSEVTTTADHPFIIINRDGVHECPAKHLSENDEVYTPADGYTASTSDITPDSETSSDSLPDGGITQTRTNQYSSHRCDADLSDDELLDITTKTIKSIETVHPSDGTDVYDLTVSGTHNFVANGMIVHNSEDRSAMHEALEQQSYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHNSISVSKAGINATLKSRCSLLGAANPKYGRFDQYEPIGEQIDLEPALISRFDLIFTVTDEPDPDADAKLADHIINTNYAGELHTQKANIPNSEFTDGEVESATAEVTPTIDAELLRKYVAYARRNCYPTMTDDAQDVIRKFYVDFRAKGADDDAPVPVTARKLEALVRLSEASARLRLSDTVEQEDAKRVTSIVESCLRDIGMDPETGEFDADIVETGTSKNQRDRIKNLKHLIENIEADYDDGAPVDEVIEQAISELGLSESKAEGEIENLRAKGEVYEPRTGSLRTT

SEQ ID NO: 1013 - protein, 794 aa, Haloquadratum walsbyi DSM 16790
  Hwa Pol-II-1 C-extein
CDGDEDCVMLLMDGLLNFSREYLPDKRGGSVAADSRLVAVSPDDKIVFTTIEDFWKKLNTPIERNGKFRKRTCVSEGWQTYAFDENHEASLRPIEKAIRYTADESEQLRRITTQLGRSLDITDEHSLFRYDDGIEEVAGDDLTAGDIIVAPRTLDVEVTQTTLDLSEYIHDNERCPSEQTGSGELNLASKSAISDSRNKETPGVTHNILPQRSKFTDEMTTLSPTAVGGLESEQNETLRVGESTGAIERYINVDDSFGWLLGQFIAQRSISTDALTMTVHTAAEKHAERIVATSDSVFGIKPTVNSIERGYEIVFPSVFDTIVSGLTAKEQSEPEQDVDHTHTDEIGIPECILHAPDDIVLSFLQGFILAENAQRKGNAASEASEMVSESETTVTLETPSVGVKDGLVFLCHRLGVITDISEKSGEEYSVHFEESRYTVSIATEGKTNPLDQILNGERPTMPEGVSVPVPDALLTIHESIANSPHIDQVIPDTVVQQETVSLETLQSLLTGLSTVDLPAQLEAKRDELTLLTEGDLSYLRVESVECVDYDGYLYDLQVGGEPVFTANWLYAHNSMDAPLVMSSRIDPSEIDDEAHNMDIVRQYPREFYEATRRMEDPDEWEEEVTIAEEYLDTDNEYTGFNHTHDTTDIAAGPDLSAYKTLDSMMDKMDAQLELARKLRAVDETDVAERVIEYHFLPDLIGNLRAFSRQQTRCLDCGESYRRMPLTGECRECGGRVNLTVHEGSVNKYMDTAIHIAEEFDCREYTKQRLEVLERSLESIFEDDTNKQSGIADFM

SEQ ID NO: 1014 - protein, 221 aa, Haloquadratum walsbyi DSM 16790
  Hwa Pol-II-2 C-extein
SMDAPLVMSSRIDPSEIDDEAHNMDIVRQYPREFYEATRRMEDPDEWEEEVTIAEEYLDTDNEYTGFNHTHDTTDIAAGPDLSAYKTLDSMMDKMDAQLELARKLRAVDETDVAERVIEYHFLPDLIGNLRAFSRQQTRCLDCGESYRRMPLTGECRECGGRVNLTVHEGSVNKYMDTAIHIAEEFDCREYTKQRLEVLERSLESIFEDDTNKQSGIADFM

SEQ ID NO: 1015 - protein, 1390 aa, Haloquadratum walsbyi DSM 16790
  Hwa PolB-1 C-extein
CDDFDVPYFLDRMEVINPQSEYTLTSERFSRIDEVWRSGWGGPNIKGRVVFDLLYAYKRTQFTELESYRLDAVGELELDVGKERYPGDIGDLWEQDPQQLLEYNLRDVELCVEIDRKQDIIAFWDEVRSFVGCKLEDATTPGDTVDIYILHEAHDRFALPSKGRTDAEDYEGGAVFDPATGVKEMVGVLDLKSLYPMAMTTINASPETKVDPKNYDGDTFRAPNGTHFRRSPDGIIREMIDDLLAEREEKKSLRNEYDPGESVYEQYDRQQTAVKVIMNCFTPDTNVLTPNGVRNIRDLTVGDSVYSLNPETMQMEIKPVTQTHEYPDYQGDLIDIQTNEIDFRVTPNHRMLVEATGTDTTSTNDYDFIEAGNLDISSRYELPHGWSVDHTDSLGAYIDLITLLREQSDTYNVLSDGGMTTAATADINHNNVTRRVDSDTFVSLIGWYVATGRVSRTQNGSDRVYLQLSQTNTKARTQLTMLLDELGVDWQADNEKIHFVSHVWTELFDTTCGRTEKNKHIPELIFDASASQKRAFFDAIINGSGVKNDDSYQYHTSSEDLRDDILRLCVHIGIVARYDYINDESWRIECTETANPDFTLTHSGRQSTAEDGVYCVTVADNQTLLAGRNGTFQWTGNSLYGVLGWDRFRLYDKEMGAAVTATGRDVIEHTADAASDLDKSVIYGDSVTGDRPVVVRDPSDYIQIVPIKLLFEQATAPEQNMRLTADGAPSVNSELPKERRHLDQWEALSLSDTGETEWQPINQIIRHQTDKEILTLQHEYGESTTTRDHSYITADDGEYVETSPENVDEPLPIPNIASVKTIETIDIYQTLTTDTQAQIGNDTEPDKWLPSADCIHANDEYVWIGTTDKQQDRDDSTPAIPRYIDLTSDTGHALIRFLAVYLSDWSKSTITTTERGQCLHITGPQESALKTCAADADQLFTHITPSIAVDAESNTNTVDSGFRCHIPTTLATTLISAFAGHPAHTKQIPSIVYHLPAAEQSLFIRHLIQAESTPESDGVSGRPQKSDKPILLENEFITTNRELAAGVSMLLTQCGQSYTISKQDTKGAYTIHINNSSSSGCTPTLTETTHSGYVYDLSVATNQNFVDGLGGLVLHNTDSVMLELGDDITEQEAIEQSFEVEEYINDSYDEFAREELDAVRHRFEIEFEKLYRRFFQAGKKKRYAGHIVWKEGKDVDDIDITGFEYKRSDIAPITKEVQRRVIEMIVHGEGTDSISEYLTDIINDFESGNVPLEDIGIPGGIGKRLESYDTATAQVRGAKYANEFLGTNFGRGSKPKRVYLRKVHPSWFREMETDSKFDPQRHGLYREFKRDPDVICFEYEDQIPDAFAVDWDLMLEKTLKGPIERIIEALGMSWNEIKSGQEQTGLGNFI

SEQ ID NO: 1016 - protein, 274 aa, Haloquadratum walsbyi DSM 16790
  Hwa PolB-3 C-extein
TDSVMLELGDDITEQEAIEQSFEVEEYINDSYDEFAREELDAVRHRFEIEFEKLYRRFFQAGKKKRYAGHIVWKEGKDVDDIDITGFEYKRSDIAPITKEVQRRVIEMIVHGEGTDSISEYLTDIINDFESGNVPLEDIGIPGGIGKRLESYDTATAQVRGAKYANEFLGTNFGRGSKPKRVYLRKVHPSWFREMETDSKFDPQRHGLYREFKRDPDVICFEYEDQIPDAFAVDWDLMLEKTLKGPIERIIEALGMSWNEIKSGQEQTGLGNFI

SEQ ID NO: 1017 - protein, 1300 aa, Haloquadratum walsbyi DSM 16790
  Hwa RIR1-1 C-extein
SGGGMGYAFWKLRPYGDSVGSTGGIASGPITFMRTYDQMCETIAQGGARRGAQMGVMRISHPDVIQFIHAKNKDVSLAHSLRLNDPDDFTHTSFADALEEARELIDEEGRVPEHLRNAVEGHLSNFNISVGVTDEFMEALFADEEFTFTNPRTEDPHIATPETKELYELHDLGEHVEVGEELSVPAEELWDHIVSGAHENGEPGVIYLERVNKEHSFDVEKHSEHEILATNPCGEQPLEEYEACNLGHINLSTLADKDAPDWRVWYDNNGDAYNNLDDAAEAFIYEAIDMNAFNRRIESGTRFLENVVTMSDFPVDEIEATVRDMRKIGLGIMGLAQLYIQIGVRYGSQEANAIAEQLMTHINHESKWASHELAKERGTFNDWTESKYANPTEYREWFEHHTGLDASEWEDGFLIRNHNTTTIAPTGCVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHNTTSMIGNTTGGCEPIYNVAYYKNVSDDVQGDEMLVEFDDYFLRVLEQNDIDVEAVKQEAQEQMANNDFDGVDGLDTVPKAIGELFVVTSDLSGKDHAGVQCACQEGIDSAISKTCNFPSSATKEDMDEVYRYIYQNGGKGVTVYRDGTRSKQVLTTRAQNTEFADESEAAETLVEQIEDVFGDVDSFLDNDTVRATVDDEIDRVLAAADGNVELGKKRPRPDVLHGVTQRIDTGYGKLYVNINEDDAGRPFELFANIGNSGGFTASFTEALAKTVSTALRSGVDPREIASELQGIRSPKVAWDKGEQINSIPDAVGTAMRRYLDGEIEKGYPQQQNLTEVGTDTGSEPRVESGSGSDAKAPGHETDGGAAVTDDTVSTNRNNGSLPSANDENNDTDDVDSLVAAGESPECPECGSMSLYYSEGCKTCESCGWSEC

SEQ ID NO: 1018 - protein, 435 aa, Haloquadratum walsbyi DSM 16790
  Hwa RIR1-2 C-extein
TTSMIGNTTGGCEPIYNVAYYKNVSDDVQGDEMLVEFDDYFLRVLEQNDIDVEAVKQEAQEQMANNDFDGVDGLDTVPKAIGELFVVTSDLSGKDHAGVQCACQEGIDSAISKTCNFPSSATKEDMDEVYRYIYQNGGKGVTVYRDGTRSKQVLTTRAQNTEFADESEAAETLVEQIEDVFGDVDSFLDNDTVRATVDDEIDRVLAAADGNVELGKKRPRPDVLHGVTQRIDTGYGKLYVNINEDDAGRPFELFANIGNSGGFTASFTEALAKTVSTALRSGVDPREIASELQGIRSPKVAWDKGEQINSIPDAVGTAMRRYLDGEIEKGYPQQQNLTEVGTDTGSEPRVESGSGSDAKAPGHETDGGAAVTDDTVSTNRNNGSLPSANDENNDTDDVDSLVAAGESPECPECGSMSLYYSEGCKTCESCGWSEC

SEQ ID NO: 1019 - protein, 336 aa, Haloquadratum walsbyi DSM 16790
  Hwa rPol A'' C-extein
TMNTFHYAGVAEIDVTQGLPRLIELVDARKTPDTPTMTVYLEEEYANERPRAHEVVWQMEATKILALGDISTNVADMLVQVDLNAETLNERWPTIGDSDLIAEEVQDIIENNLGVSTRREKMLIEFGPSEPSYRRLLQLVEELRDIVFKGLEDISRVVIRKEDNERTNGEEFVLYTEGSALGDVLPIEGVDASRTTSNNIHEVHRNLGIEAARESIINETMETLREQGLDDVNVRHLMLVADIMTNRGEIESIGRHGISGSKDSVLARAAFEVTVNHLLDAAVHGEEDDLEGVIENVIVGKPVAIGTGDVDLRMGSIDADSGRSANSGGSPELSDD

SEQ ID NO: 1020 - protein, 696 aa, Haloquadratum walsbyi DSM 16790
  Hwa Top6B C-extein
SRGQQGIGISAAVLYSQLTSGKPARITTRTQSSDTAQYFELIIDTDTNEPEVSADQERDPGAASLSPTHGTRIELEMEANMRARGQLRDYVKDTAVVNPHARITLDEPGLEEPRQYERVDGAELPAQTEEIRPHPHGVELGTLLKMLEATESYSVSGFLREEFTRVGSKTATKILDQFRDRHFGRALPMSAPETIPDNADGTDDEQVTSSLESIIEAAVVNKGASATTTFASRVAETVNQRSGTTQGELVGIVDTVAEDIEDEFETTFGTTVRENAVEAAWDVLTTDIDEDIYPLVADATSTQKDHETVRGVTDRIATKFADGSEPLRATRDAVREYVDRSADMIVSEEVSFGETARENVVDAVWTAMQTVDDELPAVKAVADDRNIASDLLEAMRLTDILAPPTDCLSPITADLVEAGLRKEFDADFYAAATRDAEVHGGDPFIVEAGIAYGGELEGGKISLLRFANRVPLVYQRGACATTDVIKSIGWRNYGLDQPGGSGMPNGPAVVMIHVASTNVPFTSESKDALANIPAIEDEIELAVREASRELKSYLNKRRSMQKRREKQDVLGRILPEMANKLADVTENDRPDIDNALARIMNNVSVERNVDNGSVTLTVQNYSDRQESPTLTDIVDSKPDTIPDEIEIVELEDEYFLTWEPVVDAGESATVTYEVPTGASFELDVDDVETEKLTIDA

SEQ ID NO: 1021 - protein, 349 aa, Invertebrate iridescent virus 6; identical to SEQ ID NO: 974
  IIV6 RIR1 C-extein

SEQ ID NO: 1022 - protein, 73 aa, Kazachstania exigua, formerly Saccharomyces exiguus, strain CBS379
  Kex-CBS379 VMA C-extein
CGERGNEMAEVLMEFPELFTEINGRKEPIMKRTTLVANTSNMPVAAREASIYTGITLAEYFRDQGKNVSMIAD

SEQ ID NO: 1023 - protein, 292 aa, Kluyveromyces lactis IFO1267
  Kla-IFO1267 VMA C-extein
CGERGNEMAEVLMEFPELFTEISGRKEPIMKRTTLVANTSNMPVAAREASIYTGITLAEYFRDQGKNVSMIADSSSRWAEALREISGRLGEMPADQGFPAYLGAKLASFYERAGKAVALGSPDRIGSVSIVAAVSPAGGDFSDPVTTSTLGITQVFWGLDKKLAQRKHFPSINTSVSYSKYTNVLNKYYEKNYPEFPVLRDRMKEILSNAEELEQVVQLVGKSALSDGDKITLDIASLIKEDFLQQNGYSTYDAFCPIWKTYDMMKSFISYHDEAQKSVSNGANWAKLSEAT

SEQ ID NO: 1024 - protein, 334 aa, Kluyveromyces lactis NRRL Y-1140
  Kla-NRRLY1140 VMA C-extein
CGERGNEMAEVLMEFPELFTEISGRKEPIMKRTTLVANTSNMPVAAREASIYTGITLAEYFRDQGKNVSMIADSSSRWAEALREISGRLGEMPADQGFPAYLGAKLASFYERAGKAVALGSPDRIGSVSIVAAVSPAGGDFSDPVTTSTLGITQVFWGLDKKLAQRKHFPSINTSVSYSKYTNVLNKYYEKNYPEFPVLRDRMKEILSNAEELEQVVQLVGKSALSDGDKITLDIASLIKEDFLQQNGYSTYDAFCPIWKTYDMMKSFISYHDEAQKSVSNGANWAKLSEATRDVKHAVSSSKFFEPSRGEEEVHAEFEKLLTNIQDRFAESTD

SEQ ID NO: 1025 - protein, 59 aa, Kineococcus radiotolerans SRS30216
  Kra DnaB C-extein
SIEQDADMVILLHREDMYEKESPRAGEADFIVAKHRNGPTDTITVAFQGHYSRFVDMAT

SEQ ID NO: 1026 - protein, 580 aa, Listonella pelagia phage phiHSIC
  LP-phiHSIC helicase C-extein
CGKSVIIAEIAKFFNEVSGKKTLVIGPNKEICQQNAEKYKSYGFPASFWSASIGKKEMRHQVVFGSPVSIKNELDKFGPQFGAVIIDEAHLLSPTVKEICSHMKEQNNLLRIVGLTATPYRLGSGYIYEYDDNNNPVGDECTKNPFFKRLVYRITAKELIDQGFLTPPIADHEMASKYDTSGVQLNKRNQFDAKDIEQAFEGQGRLTAQIIADVVSHCQNKMCCMIFAATIQHAQEIMESLPKHNSYCVTGKTKRKDREKAIERAKTGEIKYLVSVGTLTTGVDITNVDVIAILRATESASLLQQIIGRGLRLHENKTTCLVLDYAENIERHGLEDDLFNPDIRVSGGGDGSAKVNALCKSCGTVNEFTLRKGCDLDHIDEYGYALDLAGERIEMEGQPMPAHYGRRCYGGDVINGHYVRCSERWSMKVCPECEVENDIAARYCTSCRTELVDPNEKLKADYKRMKRDPRAISTDKMLGWECKPWITQRGNNTLRVDYRSEYRSFTIWYSPDSSNVKAQGLWNNLSEVVFGKGHIAPTPEAFCDALKRGFGTMPETVTVQKQGDFFRAFAHGLPEDDKPE

SEQ ID NO: 1027 - protein, 226 aa, Mycobacterium avium
  Mav DnaB C-extein
STLGLDFLRSCSIKHRMASVIFSLEMSKSEIVMRLLSAEAKIKLSDMRSGRMSDEDWTRLARRMSEISEAPLYIDDSPNLTMMEIRAKARRLRQKADLRLVVVDYLQLMSSGKKVESRQLEVSEFSRQLKLLAKELEVPVVAISQLNRGPEQRTDKKPMLSDLRESGSLEQDADMVILLNRPDAFERDDPRGGEADFILAKHRNGPTKTVTVAHQLHLSRFANMAR

SEQ ID NO: 1028 - protein, 226 aa, Mycobacterium avium 104; identical to SEQ ID NO: 1027
  Mav-104 DnaB C-extein

SEQ ID NO: 1029 - protein, 226 aa, Mycobacterium avium subsp. paratuberculosis str. k10; identical to SEQ ID NO: 1027
  Mav-PT DnaB C-extein

SEQ ID NO: 1030 - protein, 59 aa, Mycobacterium bovis subsp. bovis AF2122/97
  Mbo-AF2122 DnaB C-extein
SLEQDADVVILLHRPDAFDRDDPRGGEADFILAKHRNGPTKTVTVAHQLHLSRFANMAR

SEQ ID NO: 1031 - protein, 235 aa, Mycobacterium bovis subsp. bovis AF2122/97
  Mbo Pps1 C-extein
CTAPIYKSDSLHSAVVEIIVKPHARVRYTTIQNWSNNVYNLVTKRARAEAGATMEWIDGNIGSKVTMKYPAVWMTGEHAKGEVLSVAFAGEDQHQDTGAKMLHLAPNTSSNIVSKSVARGGGRTSYRGLVQVNKGAHGSRSSVKCDALLVDTVSRSDTYPYVDIREDDVTMGHEATVSKVSENQLFYLMSRGLTEDEAMAMVVRGFVEPIAKELPMEYALELNRLIELQMEGAVG

SEQ ID NO: 1032 - protein, 99 aa, Mycobacterium bovis subsp. bovis AF2122/97
  Mbo RecA C-extein
CSPPFKQAEFDILYGKGISREGSLIDMGVDQGLIRKSGAWFTYEGEQLGQGKENARNFLVENADVADEIEKKIKEKLGIGAVVTDDPSNDGVLPAPVDF

SEQ ID NO: 1033 - protein, 268 aa, Methylococcus capsulatus Bath, prophage MuMc02
  Mca MupF C-extein
CRCRVRPRSERSLARDGIAWQSSAGKLRTLETDAGVDKRTGEITHARRTGIDVVDADGKKHFFAPDAGFNFNPGQGWSKPFTPPPLDTLPKTFSPGQVLPDLPKPEKFAASMIVPDGLGEEDYAKAFLAEFGADLGKPVVFQDVTGDPMLIDEALFKSGAGEWKATKDGRGPYMRLLAHAIRSPDEIWMRWEESRERPGTWLLKRRYLKTFEIDGHGSESPQYGLSVFEYGSEGWSGSTAMISQASRGPGARRRYIERQRDGFLLFRR

SEQ ID NO: 1034 - protein, 655 aa, Methylococcus capsulatus Bath
  Mca RIR1 C-extein
CAEQPLPAYGCCCLGSLDLTRFVSRPFTPEAAFEAERLAEVATIAVRMLDNVLDTTYWPLARQRQEAQAKRRIGLGFTGLGDALAMLGLRYDSAAARDMAAGIARRLRDAAYLASTALAREKGAFPLFEAEPYLASPFVAGLPEPLRARILESGIRNSHLLSIAPTGTISLAFADNTSNGIEPPYAWTYLRKKREPDGSTREFPVEDHAYRLYRATAGDRPLPPAFVTALDISALDHMRMLAAVQPFVDASISKTVNVPADYPYADFQHLYLEAWKAGLKGLATYRPNPVTGAVLEATPTHGISRPEFDESDPDRRLRLDEVPAPALASLRWRRRPRPAAGNPAWSYLIDHPLGSFAVFIGHIEDHGNHPFEVWVTGAEQPRGLGALAKSLSMDMRSNDRGWLKTKLESLMKAHGDDGFDLPFPPNGRPVRVPSLVAGFARLIYYRCAELGAFDTLADTPVVDALMSPKEPKTGPDGTLSWTVDILNVATGDDFVMGLKELVLPNGQRRPYSMWLSGEYPRVLDGLCKSLSFDMRVIDPAWIGAKLRQLLDFPEPRGDFLARMPGTGRQRNYPSTVAYMAQLAIHRYAMLGLLDEQGRPLQDMGLMDYESAGPETGEAKPPVLKGARCPECGNDAVIRRDGCDFCTACGALGGCG

SEQ ID NO: 1035 - protein, 50 aa, Mycobacterium chitae
  Mch RecA C-extein
SPETTTGGKALKFYASVRIDVRRIETLKDGTDAVGNRTRAKIVKNKVSPP

SEQ ID NO: 1036 - protein, 287 aa, Methanoculleus marisnigri JR1
  Memar MCM2 C-extein
SISVAKAGITATLKSRCALLGAANPKLGRFDQFVPIGEQINMPPSLLSRFDLIFVMTDQPEVQRDGAIAQHIIKTHSVGELIKQHEYEPLPDVDDAYIERALAPVIPDIDPTLLRKYIAYAKRTCFPILSDGAKEALIAYYMRLRNLASGNKPVPVTARQLEALVRLAEASARMRLSNTVDTEDTDRILKIVDACLRQVAYDAESGSFDIDKLVTGVTKSQRDIIRSVKEAIRNVSGDSGGQARVDEVIEILLQQGFSRDKIEHTLEQLKRGGEVLEPRHGLVKLIG

SEQ ID NO: 1037 - protein, 250 aa, Methanoculleus marisnigri JR1
  Memar Pol-II C-extein
CDGDEDCVMLLLDGLINFSRAYLPETRGGTMDAPLVLTTRIDPSEVDKESHNVDVCDHYPIEVYNGCLAYAHPKDLDAFVDRVERRLGTPAQCEGFLFTHQTSNISAGPLESTYTRLGSMLDKLEAELDLAKRIRAVDEDDVAERVLNTHFIRDLQGNLNAFSKQKVRCMKCNAKYRRMPLAGKCTRCGGHVIPTVHEGSVKKYLEMSRNICATYAISDYTKQRVEVLFMQIESTFGEPPEKQLGLADFM

SEQ ID NO: 1038 - protein, 50 aa, Mycobacterium fallax
  Mfa RecA C-extein
SPETTTGGKALKFYASVRMDVRRIETLKDGSDAVGNRTRVKVVKNKVSPP

SEQ ID NO: 1039 - protein, 64 aa, Mycobacterium flavescens Fla0
  Mfl GyrA C-extein
TEARLTPLAMEMLREIDEETVDFIPNYDGRVQEPTVLPSRFPNLLANGSGGIAVGMATNIPPHN

SEQ ID NO: 1040 - protein, 50 aa, Mycobacterium flavescens, ATCC14474
  Mfl-ATCC14474 RecA C-extein
SPETTTGGKALKFYASVRMDVRRIETLKDGADAVGNRTRVKVVKNKVSPP

SEQ ID NO: 1041 - protein, 67 aa, Mycobacterium gastri
  Mga GyrA C-extein
TEARLTPLAMEIVREIDEETVDFIPNYDGRVQEPTVLPSRFPNLLANGSGGIAVGMATNIPPHNKGE

SEQ ID NO: 1042 - protein, 42 aa, Mycobacterium gastri
  Mga RecA C-extein
SPETTTGGKALKFYASVRMDVQRIETLKDGTNTVDNRTRVKI

SEQ ID NO: 1043 - protein, 141 aa, Mycobacterium gastri
  Mga SufB (Mga Pps1) C-extein
SEVVYHQIREDLEAQGVIFLDTDTGLREHPDVFKQYFGTVIPAGDNKFSALNTAVWSGGSFIYVPPGVHVDIPLQAYFRINAENMGQFERTLIIVGENAYVTYVEGCTAPIYKSDALHSAVVEIIVKPGGRCRYTTIQNWS

SEQ ID NO: 1044 - protein, 249 aa, Methanospirillum hungateii JF-1
  Mhu Pol-II C-extein
CDGDEDCVMLLLDGLINFSRSFLPVTRGGSMDAPLVLTSRIDPTEIDKESHNLDVCATYPIEVYETALRYGNAKDVESLVDRVERRLNTPAQIEGFFFTHDTSDISAGPLETMYTQLQSMLDKLDCELSLAKRIRAVDEHDVAERVLKTHFIRDLQGNLSAFSKQKFRCTKCNTSYRRMPLAGKCKCGGNIIPTVHEGSVKKYLQMSRQICEEYNITEYTRQRIEVIDMNIESTFGEEKVEQMGLADFM

SEQ ID NO: 1045 - protein, 529 aa, Methanococcus jannaschii (Methanocaldococcus jannaschii DSM 2661)
  Mja GF-6P C-extein
SRWATHGNVCKENAHPHTDCKEEIAVVHNGIISNYKELKDELMKKGHKFKSETDTEVVPHLIEEELKKFKEINEENYIKAVKNAIKKLKGTYALVIINKNFPNLLIGARNESPLILGINDDGYFLGSDITAFLDYTNKAIPLEDGDVVVIKKKENGYEVTIENNGNTVEREMMEINWDISSAEKMGYPHFMLKEIMEQPEVLKVSAKISAEEIKELAKCIKDYDRVYFVAMGTSLHAAMVVEYLFAKLGKLVIACDASEFLNKGVVDDKTLVIGITQSGETYDTLKALRFAKKNKAKTGAIVNVLGSTATREADITVMMGAGIEIAVCATKTYTSQLMILYRLFIEYGKLLGRDMSEYEKEIDKIPNYIKEVLDKKETIKEIANNLKVNNYIFISKGINIASALEGALKFKEITYLHAEGMSGGLLKHGTISLIDENMDTVAIVPPRDSAVFNSILSNIEEVKARGGKVIAITPTEIDGAENILVPEVIEEISPIVYAPAFQLLAYYKAVELGRDVDKPRGLAKSVTVE

SEQ ID NO: 1046 - protein, 357 aa, Methanococcus jannaschii (Methanocaldococcus jannaschii DSM 2661)
  Mja Helicase C-extein
SAGLNLPCRRAIVKDLTRFTNKGMRYIPIMEIQQCIGRAGRPGLDPYGEGIIVAKNDRDYLRAYQALTQKPEPIYSKLSNQAVLRTQLLGLIATGEIRDEYDLEWFIRNTFYAHQYGNLREVAKNINEVIRFLEENEFIIDFMPTELGKRVSELYIDPLSAKFIIDGLEEMENEEEIYYLYLISKTLEMMPNLRVYNSEELNLIDEMDSLGIKSFEIEDLEAFKTAKMLYDWINEVPEDEILKRYKIEPGILRYKVENAVWIMHALKEIAKLIGKSSDIPEKLEIRLEYGAKEDIIELLSIKYIGRVRARKLYNAGIRSIEDIINNPSKVASIIGEKIAKKILDELGVKFGQQKLSF

SEQ ID NO: 1047 - protein, 265 aa, Methanococcus jannaschii (Methanocaldococcus jannaschii DSM 2661)
  Mja Hyp-1 C-extein
CFTPWTSLYKSFDSIYDCYNKKPDFVELGLSADTDMADMIPELRDLPFLSNSDAHSYHPHRLGREFNQIEVDYIGGIEDNFEQIKKAIKHNKIIANYGLDPKLGKYHLTACSKCHTRFKLEDAKKYNWKCPKCGGSIKKGVLSRVEELSDGKIEHPKFRPPYYKLIPLAEMISLTIGKGIFTKAVQSLWEEFIKKYGNEIEVLINADIDELSKIHPKVAETINLFRKGKIYIYPGGGGEYGKISFKPQKVEWYREEVTLDRWLKQ

SEQ ID NO: 1048 - protein, 579 aa, Methanococcus jannaschii (Methanocaldococcus jannaschii DSM 2661)
  Mja IF2 C-extein
TTLLDKIRKTRVAKREAGGITQHIGASEIPIDVIKRLCGDLLKMLKADLKIPGLLVIDTPGHEAFTSLRKRGGALADIAILVVDINEGFKPQTVEAVNILRQCKTPFVVAANKIDLIPGWNSKEGPFILNFNEKNQHPNALTEFEIRLYENIIKPLNELGFDADLYSRVQDVTKTVCIIPVSAVTGEGIPDLLMMVAGLAQKFLEDRLKLNVEGYAKGTILEVKEEKGLGTTIDAIIYDGIAKRGDYLVVGLPDDVLVTRVKALLKPKPLDEMRDPRDKFKPVNEVTAAAGVKIAAPELDKVIAGCPIRIVPKDKIEEAKEEVMKEVEEAKIEVDDEGILIKADTLGSLEALANELRKAGVKIKKAEVGDVTKKDVIEVASYKQSNPLHGAIVAFNVKILPEAQKEIEKYDIKVFLDNIIYKLVEDFTEWIKKEEERIKYGEFEKLIKPAIIRILPDCIFRQKDPAICGVEVLCGTLRVGAPLMREDGMQLGYVREIKDRGENVKEAKAGKAVSIAIDGRVVLKRHVDEGDYMYVAVPESHVRELYHKYMDRLRNDEKEALLRYMELMQKLTNNIFWGR

SEQ ID NO: 1049 - protein, 149 aa, Methanococcus jannaschii (Methanocaldococcus jannaschii DSM 2661)
  Mja Klba C-extein
CSGTLHANSADEAILRLTSPPMNVPKIMLTALNFIINQQRIRRAGKTIRRILGIVEIVKGGGEGHEFAKTTLYEYNGLKDSLERRGICMWEEEVCEIAGITKEELLRDRENRKKVLSYLYKNNIRKLENVSDYIMRYQVDPEKLLRSIR

SEQ ID NO: 1050 - protein, 366 aa, Methanococcus jannaschii (Methanocaldococcus jannaschii DSM 2661)
  Mja PEP C-extein
CHAAIVSRELGTPCVVGTKKATKVLKDGMIVTVDGEKGIVYEGEIKKVEEKEKKQEVVVQQAPIITATEVKVNVSMPEVAERAAATGADGVGLLRAEHMILGLGKHPRKILEEEGEEALIEALMEGIRKVADAFYPRPVTYRTLDAPTDEFRGLEGGENEPIEHNPMLGWRGIRRDLDEVDILKCELKAIKRLREEGYKNIEIMIPLVTHPDEVRRVKEIMREVGLEPCKDIPFGIMVETPAAALIIEDFIKEGINFVSLGTNDLTQYTIAIDRNNELVSKYYKEDHPAVLKLVEHVIKTCKKHGIKTSICGQAGSRPHIVEKLVEWGIDSVSANIDAVETIRRVVARTEQKVILNYIRKSYVERE

SEQ ID NO: 1051 - protein, 840 aa, Methanococcus jannaschii (Methanocaldococcus jannaschii DSM 2661)
  Mja Pol-1 C-extein
SLYPSIIISYNISPDTLDCECCKDVSEKILGHWFCKKKEGLIPKTLRNLIERRINIKRRMKKMAEIGEINEEYNLLDYEQKSLKILANSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNSVYGYLAFPRARFYSRECAEIVTYLGRKYILETVKEAEKFGFKVLYIDTDGFYAIWKEKISKEELIKKAMEFVEYINSKLPGTMELEFEGYFKRGIFVTKKRYALIDENGRVTVKGLEFVRRDWSNIAKITQRRVLEALLVEGSIEKAKKIIQDVIKDLREKKIKKEDLIIYTQLTKDPKEYKTTAPHVEIAKKLMREGKRIKVGDIIGYIIVKGTKSISERAKLPEEVDIDDIDVNYYIDNQILPPVLRIMEAVGVSKNELKKEGAQLTLDKFFK

SEQ ID NO: 1052 - protein, 276 aa, Methanococcus jannaschii (Methanocaldococcus jannaschii DSM 2661)
  Mja Pol-2 C-extein
SVYGYLAFPRARFYSRECAEIVTYLGRKYILETVKEAEKFGFKVLYIDTDGFYAIWKEKISKEELIKKAMEFVEYINSKLPGTMELEFEGYFKRGIFVTKKRYALIDENGRVTVKGLEFVRRDWSNIAKITQRRVLEALLVEGSIEKAKKIIQDVIKDLREKKIKKEDLIIYTQLTKDPKEYKTTAPHVEIAKKLMREGKRIKVGDIIGYIIVKGTKSISERAKLPEEVDIDDIDVNYYIDNQILPPVLRIMEAVGVSKNELKKEGAQLTLDKFFK

SEQ ID NO: 1053 - protein, 253 aa, Methanococcus jannaschii (Methanocaldococcus jannaschii DSM 2661)
  Mja r-Gyr C-extein
CTYHRTSSTRVSLDGMRVAREYLKLNNLEDYLKNREYFMEGAHECIRPTKPMNTDELIEFLKENNIKLTKNHIKVYDLIFRRFIASQMKEAVVEYEEIYIKDLDEKVEGYVDIKFDGWSRIYNLKLKKLPRIEKSSLKVLDKKLRKIPKVPLYDEGEVVKLMKERGIGRPSTYAQIIKKLLDRGYVVKSKDKNKLIPTKLGIEVYNYLINNYPHLISEERTRELEEIMDKIENGEVDYIEVLKALHEEILSIR

SEQ ID NO: 1054 - protein, 1246 aa, Methanococcus jannaschii (Methanocaldococcus jannaschii DSM 2661)
  Mja RFC-1 C-extein
TTAALCLARDLFGENWRDNFLELNASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSDERGIDVIRTKVKDFARTKPIGDVPFKIIFLDESDALTADAQNALRRTMEKYSDVCRFILSCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNCNYPSKIIPPIQSRCAVFRFSPLKKEDIAKKLKEIAEKEGLNLTESGLEAIIYVSEGDMRKAINVLQTAAALSDVIDDEIVYKVSSRARPEEVKKMMELALDGKFMEARDLLYKLMVEWGMSGEDILNQMFREINSLDIDERKKVELADAIGETDFRIVEGANERIQLSALLAKMALMGR

SEQ ID NO: 1055 - protein, 785 aa, Methanococcus jannaschii (Methanocaldococcus jannaschii DSM 2661)
  Mja RFC-2 C-extein
SDERGIDVIRTKVKDFARTKPIGDVPFKIIFLDESDALTADAQNALRRTMEKYSDVCRFILSCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNCNYPSKIIPPIQSRCAVFRFSPLKKEDIAKKLKEIAEKEGLNLTESGLEAIIYVSEGDMRKAINVLQTAAALSDVIDDEIVYKVSSRARPEEVKKMMELALDGKFMEARDLLYKLMVEWGMSGEDILNQMFREINSLDIDERKKVELADAIGETDFRIVEGANERIQLSALLAKMALMGR

SEQ ID NO: 1056 - protein, 180 aa, Methanococcus jannaschii (Methanocaldococcus jannaschii DSM 2661)
  Mja RFC-3 C-extein
CNYPSKIIPPIQSRCAVFRFSPLKKEDIAKKLKEIAEKEGLNLTESGLEAIIYVSEGDMRKAINVLQTAAALSDVIDDEIVYKVSSRARPEEVKKMMELALDGKFMEARDLLYKLMVEWGMSGEDILNQMFREINSLDIDERKKVELADAIGETDFRIVEGANERIQLSALLAKMALMGR

SEQ ID NO: 1057 - protein, 960 aa, Methanococcus jannaschii (Methanocaldococcus jannaschii DSM 2661)
  Mja RNR-1 C-extein
TIFSSINLELEIPEFLKDKPAVIAGTTRGTYGDYEEEAKLILEALVDVMMEGDAMGKPFLFPNFIIKLRENAFKDENKELMYKIHQLSAKFGIPYFINMLPDWQVTNTNAMGCRTRLSGNWTGDAEIDTLRTGNMQWYSLNLPRIAYEANGDDTKLFEILHERLEILKEALLIKHEVTKERLYVDNLMPFLTQEFDGESYYRYENTTKTFGFVGLNEMLKYHLGEELHESKDAVKFGEKVIEYIREYADKLKEETGLRWTVTQTPAESSLPYDEKILIFENNEYKLVKIGEFVEKYLNRYKDRAITYGDNNIEVYIKDENIYAPSFDKDGKIVLKPITHAIRHRGKEIYEIELESGKKVRVTGDHSVFTINDNLDVVEVKASDLKVGDFIITPKIIPSISKDKIYLSEIVKNKDKYYVKIKDHIKFIEEHEEILKESYKEYKTKWKDLKPVLKKKNAFRLDLIEDLVDKEKIEKISYGHANYINNKIKLDEKFGYLIGAFLSEGHWNDKCVEISSTNKEFIENLVEIIEEILGKDAYYITVKGDKRRYKDLYVIGLNKTVAMIFESLGLNKLSSNKEIPSILLSNETFLKGLIKGYIDGDGSIYVDESKRDYSIRLYTTSETLRDTLCLALKILGINYRLSIDKKSKVNENWRDCYVIKITGKENIEKLLDVEIKNNGGKDVIPKIAEKFKEIINQYSQREWKERFGIDVNNLHIWEDLKKGYMSRYRAKKVLNIMKNVKEIEEKYGRLLDKIGQLIDNDLLFERIKSIRVLDEIPEYVYDISVEGTENFIGGEGFICLHNTAGRFARLDYKYYKEETISVVRGDLNDVDSLYYTNSSHVRVDAPITLGEKVRIEEKFHPLCNGGHIMHIWNIESAADPEVLMDITKKITKTHIGFWTYTKNLSVCNRCGISMGGLRDRCINCGSEDVAKFSRITGYLQNISNWNRAKQKELEDRKLPRI

SEQ ID NO: 1058 - protein, 1018 aa, Methanococcus jannaschii (Methanocaldococcus jannaschii DSM 2661)
  Mja RNR-2 C-extein
TAGRFARLDYKYYKEETISVVRGDLNDVDSLYYTNSSHVRVDAPITLGEKVRIEEKFHPLCNGGHIMHIWNIESAADPEVLMDITKKITKTHIGFWTYTKNLSVCNRCGISMGGLRDRCINCGSEDVAKFSRITGYLQNISNWNRAKQKELEDRKLPRIMDMEALKQKIEGLDIPQSLKDELFEKLSKEKDLTEEMVDEIIDEVVNAYRKALVEPYEAVGIVAAQSIGEPGTQMSLPYEEKIIIKEGEFIKPVEIGKLVDEMIERFGFEKIGNSEVCDLPIDIYALSLDQDEKVHWKRIISCIRHKHNGKLIKIKTKSGREITATPYHSFVIRKDNKIIPVKGSELKIGDRIPVVKHIPANCVEAINISDYVSGNYVVDNINNKIAPKINGKSIPNNIKLDYDFGYFIGIYLAEGSVTKYFVSISNVDELILNKIRAFADKLGLNYGEYDNNNGFAESHDIRIYSSTLAEFLSNFGTSSNTKKIAEFVFGANKEFVRGLIRGYFDGDGNVNADRKVIRVTSNSKELIDGIAILLARFNIFSIKTKTKNQFVLIIPHRYAKKFHEEINFSVEKKKSELERLVSSLNDDKTYDSIDMIPSIGDALTKLGEKVDYPKVILKKFERKQKIGRATLQRHLRRIEELAVKKGVNILALKEYWLLKKAVESDVIWDEIVKIEEISCDKKYVYDISVEGLETFTTFDGVLTHNTMRTFHYAGVAEINVTLGLPRMIEIVDARKEPSTPIMTIYLKEEYKDNREKAEEIAKEIESLTLGSIAESISIDLWTQSIKVELDENRLADRGLTIDDVIEAIKKKLKVKIDVDGTTLYLKIKTPSIKALRKRIPKIKNIQLKGIPGIERVLVKKEGGEYVLYTQGSNLREVFKIDGVDTTRTITNNIIEIQEVLGIEAARNAIINEMRNTLEQQGLEVDIRHLMLVADIMTADGEVKPIGRHGVAGEKGSVLARAAFEETVKHLYAAAERGDVDKLKGVIENVIVGKPIYLGTGCVELTIDREYEEGKNMEE

SEQ ID NO: 1059 - protein, 430 aa, Methanococcus jannaschii (Methanocaldococcus jannaschii DSM 2661)
  Mja rPol A' C-extein
CPPYNADFDGDEMNLHVPQSEEARAEAEALMLVEKHILSPRFGGPIIGAIHDFISGAYLLTSNYFTKDEATLILRSGGIKDELWEPDKVENGVPLYSGKKIFSKALPKGLNLRYKAKICRKCDVCKKEECEYDAYVVIKDGELIKGVIDKNGYGAEAGLILHTIVKEFGPEAGRKFLDSATKMAIRAVMLRGFTTGIDDEDLPEEALKEIEKVLDEAEEKVKEIIEKYERGELELLPGLNLEESREAYISNVLREARDKAGAIAERYLGLDNHAVIMAVTGARGNILNLTQMAACLGQQSVRGKRIFRGYRGRVLPHFEKGDLGARSHGFVRSSYKKGLSPTEFFFHAMGGREGLVDQAVRTAQSGYMQRRLINALQDLKTEFDGTVRDSRGIMIQFKYGEDGIDPMLADRGKAVNIDRIIDKVKMKYNQ

SEQ ID NO: 1060 - protein, 383 aa, Methanococcus jannaschii (Methanocaldococcus jannaschii DSM 2661)
  Mja RtcB (Mja Hyp-2) C-extein
CGVRLIRTNLTKEEVQSKIKELIKTLFKNVPSGLGSKGILKFSKSVMDDVLEEGVRWAVKEGYGWKEDLEFIEEHGCLKDADASYVSDKAKERGRVQLGSLGSGNHFLEVQYVEKVFDEEAAEIYGIEENQVVVLVHTGSRGLGHQICTDYLRIMEKAAKNYGIKLPDRQLACAPFESEEGQSYFKAMCCGANYAWANRQMITHWVRESFEEVFKIHAEDLEMNIVYDVAHNIAKKEEHIIDGRKVKVIVHRKGATRAFPPKHEAIPKEYWSVGQPVIIPGDMGTASYLMRGTEIAMKETFGSTAHGAGRKLSRAKALKLWKGKEIQRRLAEMGIVAMSDSKAVMAEEAPEAYKSVDLVADTCHKAGISLKVARMRPLGVIKG

SEQ ID NO: 1061 - protein, 239 aa, Methanococcus jannaschii (Methanocaldococcus jannaschii DSM 2661)
  Mja TFIIB C-extein
TIHDKGLSTVIDWRNKDSYGKDLSANKRAQLYRLRKWQRRIRVSDAAERNLAFALSELDRITSKLGLPRHVRENAAIIYRGAVEKGLIRGRSIEGVVAAAIYAACRRCRVPRTLDEIAEASRVDRKEIGRTYRFLARELNIKLTPTNPIDYVPRFASELGLPGEVESKAIQILQQAAEKGLTSGRGPTGVAAAAIYIASVLLGCRRTQREVAEVAGVTEVTIRNRYKELTEHLDIDVTL

SEQ ID NO: 1062 - protein, 181 aa, Methanococcus jannaschii (Methanocaldococcus jannaschii DSM 2661)
  Mja UDP GD C-extein
CFPKDVKALIKQFENNNIEPILIKATDIVNEEQIKWFFEKIKNYYGNLNGKTFAVLGLAFKPNTDDLRESRAIKLIDMLLESGAIVKGFDYVEKARENTINMYKLDKSKGFYGYNLYVLDDLYETVKNVDGIIITVEYDFNKEDWEKIGNLVKEKVVFDGRNILDVEKIKKLGFKYYGVGR

SEQ ID NO: 1063 - protein, 221 aa, Methanopyrus kandleri AV19
  Mka CDC48 C-extein
SEKKIREIFQKARQTAPCVIFFDEIDAIAPKRGTEVGGSRVTERIVNQLLTEMDGIEATEDVFVIAATNRPDIIDEALLRPGRFDRIVYVPPPDEEAMKEIVKIHTRDMPLAEDLTVDDIVEILRRREREEDAKYTGADIEAVCMEAAMLALREVLDELERIEKESETEEELEARKEALLEELRVERRHFEKAVEKVPPSVPKEKLEEYEKLKEEYQRLAG

SEQ ID NO: 1064 - protein, 248 aa, Methanopyrus kandleri AV19
  Mka RFC C-extein
SDERGIDVIRTKVKNFARTRPMGGARFKIIFLDEADNLTRDSQQALRRIMEMYSDACRFILAANYSSAIIDPIQSRCVVFKFTKLPESAIKERLRKIAESEGVEITEDALDAIVYVSEGDMRRAINVLQAAAALGREIDEDTVFQIAATARPEEVREMIHHAWNGDFERARELLHELLTRYGMSGEDVVRQVHREIFDMDEIPEEAIPELVNAVGDFEYRLIRGSDERIQLEALLARIHALGNEYSGG

SEQ ID NO: 1065 - protein, 406 aa, Methanopyrus kandleri AV19
  Mka RtcB C-extein
CGVRVMKTDLTEDDVRPKLRELLETIFRNVPAGLGSRHRRVRLSTQELRQVMLYGAEWAVEEGFGFDEDLDHIESRGNMTHAYETIGWEEYGPRDDVASKRAIERGRPQLGTLGSGNHFLEVQVVDEIYDKEAAEKMGIREEGQVTIMVHTGSRGFGHQVCSDHLRIMERSMRDVERRFGVRIPDRQLACAAMGTDEAKRYFNAMNAAANYAFANRQMISHWTRESFVEVFGDEYGDADDMGIEVIYDIAHNMAKIEKHPVDGEERWLVVHRKGATRAFSEEALKKHGEPVPFEGLPQPVLIPGDMGTGSYILIGTEKAMEETWGSTCHGAGRTMSRAAAKRKFWGEDVARELERQGILVKAASMPVVAEEAPPAYKDVDEVVRAVAEAGISDPVVRLRPIGVVKG

SEQ ID NO: 1066 - protein, 213 aa, Methanopyrus kandleri AV19
  Mka VatB C-extein
CEALREISAAREEVPGRRGYPGYMYTDLATIYERAGCIRGRKGSITQMPILTMPHDDITHPIPDLTGYITEGQIVLSRDLHRRGIYPPIDVLPSLSRLMDEGIGKGKTREDHPDLSNQLYAAYAEGRDLRDLVAVVGEEALTERDRKFLKFADEFEQRFVKQGRDENRSIEETLDLGWELLAILPERELKRVSDELIEKYHPKYRQKKEEQEE

SEQ ID NO: 1067 - protein, 64 aa, Mycobacterium kansasii; identical to SEQ ID NO: 1039
  Mkas GyrA C-extein

SEQ ID NO: 1068 - protein, 226 aa, Mycobacterium leprae, strain TN
  Mle DnaB C-extein
STLGLDFMRSCSIKHRLASVIFSLEMSKSEIVMRLLSAEAKIKLADMRSGRMTDDDWTRLARRMSEISEAPLYIDDSPNLTMMEIRAKARRLRQKTNLKLVVVDYLQLMTSGKRFESRQVEVSEFSRHLKLLAKELELPVVAISQLNRSPEQRTDKKPMLSDLRESGSLEQDADVVILLHRPDAFDRDDPRGGEADLILAKHRNGPTKTVTVAHQLHLSRFTNMAR

SEQ ID NO: 1069 - protein, 141 aa, Mycobacterium leprae, strain TN
  Mle RecA C-extein
SPETTTGGKALKFYASVRMDVRRIETLKDGVDAVGNRTRVKIVKNKVSPPFKQAEFDILYGKGISREGSLIDMGVEQGFVRKSGSWFTYEGEQLGQGKENARNFLLENADVANEIEKKIKEKLGIGAVVTDDDILPTPVDF

SEQ ID NO: 1070 - protein, 219 aa, Bacteriophage Aaphi23
  MP-Aaphi23 MupF C-extein
CRCVAIPVFDEAQSKAKAQETLSEPVKENLTLSIDKLVEKSKKIEQTITADINNITIKAGGKLVGLENRLKTAPSIKRKIEAEVADGFSKSLSLNKIGDAIRYTTVFKEGDFVTRYKAMQYLLAIKGYKTIIVKNTWKNDSAYTGVNTFIQNEDGDVFEMQYHTQQSFDLKNGLLHKIYKQFRNPKTPFHEKEKLLLEMRKLSSKIKVPKGIELIEDKK

SEQ ID NO: 1071 - protein, 422 aa, Mycobacteriophage Bethlehem
  MP-Be DnaB C-extein
TKNTFSLFPIMVSKKLKTEYGLSVNRFIIYSEIGGRLEAATASPASMEGNRPTFVVQNETQWWGVGPGGEVNDGHQMAEVIEGNMTKVDGARTLSICNAHRPGDDTVAEMSYLNWLDILAGDAIDTGVLYDALEAPADTPVSEIPFPSDDPEGYEAGVAQLMKGLEIARGDSIWLPLDDILMSVLTAKNDVIESRRKFLNQVNATEESWIAPSEWDRNHDINLPPLRKGERITLGFDGSLSNDHTALTACRVEDGALFLVKVWVPEKYEGHKVPRQDVDAYVRSMFEKYDVVGMRADVKEFEQSVDAWGQDFRRKLKINASPGNPVAFDMRGQQKRFALDCERFRDAVLAGEVKHDNNPVLKAHITNAHQHPTIYDAISIRKPGKESKRKIDAAVTAVLAWGSRQDFLLSKSNTGKGAGLLR

SEQ ID NO: 1072 - protein, 161 aa, Mycobacteriophage Bethlehem
  MP-Be gp51 C-extein
SRARDYLSKNAPALEGTHAFDIDVLLDFDGFGVELLPDFYDIAPGWISTHGHMGKMTLSQIAGSTALNGAKKFGKSVVCGHTHRQAVVSHSFGYGGSVRKTVTGMEVGHLMDMKKANYLKGGAGNWQMGFGMLTVDGKHVKAEIVPILGGKFTVDGRVWEV

SEQ ID NO: 1073 - protein, 107 aa, Mycobacteriophage Catera
  MP-Catera gp206 C-extein
TQNSRSFDFQDTIKPIWDAQLSLGLHGTGHPLGILLVVESGYPFRMREYRVPRNDQLLTQIFQKFDYVRECIALNKVPEYCCMPQSKEMDACPARYQCWLKDKVEAS

SEQ ID NO: 1074 - protein, 464 aa, Mycobacteriophage CJW1
  MP-Mcjw1 DnaB C-extein
TELLAGIMLYLLVADGEQSGEIYGVARDKKQAALAFDVAAQMVKFSPILSKRLKVVDYKKRIYDAKTNSFYDVIAADAKSALGSNPSGCGADEILAWQDGGMWDSLRTGMGSGARVQPLMVASTTAGNDTEGFAGLKHREMERVMEDPDNPDFKHIFVYMRNTPMEEDPWNEECWPHANPALGRFLSWEAMRKQAAEARNNPIAEMAFRQFKLNQWQNSTIRWMRMPAWDECKGTVFKSNKDLFDAFAGQSCWFGLDLAARRDLCSICYLFPQSDGSVDLLWRHWIPESALAKLDRLNDGRFAKEFVPGGWLKVTEGDVLDFDVVYDDIEADAKRFTILGGDADQWSSDPVIQEIEKRTYLYEDIFAYKNDFAHMSDSMHRIFEWTLAKNLRHHGNPLARFCFSACEARVAAYDPNLIRPDKPDRDMAAKRIDAVPTAVMATNAFYTRGNDYDSVYEEREALSV

SEQ ID NO: 1075 - protein, 404 aa, Mycobacteriophage Omega
  MP-Omega DnaB C-extein
TAVNGMERLESLIAKSGLKYKAKQAHGAESIEILDGPNPGARVMFQTRTDRSGLGLTADRVIFDEAMTITPGSLKALLPTVSSRPNPQIVYTGTAADQRTQPYCHTFGGVRYRALEQLRTGERKRLCFLEWSAPDDLPEEKFGDPQYWAMANPGLGYRQTEEKILDEYEEMWANLRDFGVDRLGIGDWPQFGAEMSEIPLDKWRRLNNPSPDLAGARALILYRTPEGGPWAIVGSQRCTDGRIHVEVGYAGTDPVDRVVDKFIQAITAWGPEEILVGRGGAAEVIPQIEAAGFTVYSPNQSEEAQACGGFLNDALVDPENPLLSHGDQHSLNAAITRAVKRDLPSGGFVWDCIEPSTYAQLMGVTLGRWALLKHAINAKPTPAIHDWPDQQEIDSWIQELYEEA

SEQ ID NO: 1076 - protein, 161 aa, Mycobacteriophage U2
  MP-U2 gp50 C-extein
SRARDYLSKNAPALEGTHAFDIDVLLDFDGFGVELLPDFYDIAPGWISTHGHMGKMTLSQIAGSTALNGAKKFGKSVVCGHTHRQAVVSHSFGYGGSVRKTVTGMEVGHLMDMKKANYLKGGAGNWQMGFGMLTVDGKHVKAEIVPILGGKFIVDGQVWEV

SEQ ID NO: 1077 - protein, 50 aa, Mycobacterium shimodei
  Msh RecA C-extein
SPETTTGGKALKFYASVRMDVRRIETLKDGTDAVGNRTRVKVVKNKVSPP

SEQ ID NO: 1078 - protein, 227 aa, Mycobacterium species KMS
  Msp-KMS DnaB C-extein
STLGLDFMRSCSIKHQLPSVIFSLEMSKSEIVMRLLSAEAKIKLADMRSGRMSDDDWTRLARRMSEISEAPLYIDDSPNLTMMEIRAKARRLHQKAGLRLIVIDYLQLMTSGKKVESRQQEVSEFSRNMKLLAKELEVPVIAMSQLNRGPEQRTDKKPMLSDLRESGAIEQDADMVILLHRPDAFERDDPRGGEADLIVAKHRNGPTKTITVAHQLHLSRFANMAHA

SEQ ID NO: 1079 - protein, 706 aa, Mycobacterium species KMS
  Msp-KMS GyrA C-extein
TEARLTPLAMEMLREIDEETVDFIPNYDGRVQEPTVLPSRFPNLLANGSGGIAVGMATNIPPHNLRELADAVYWCLENFEADEETTLAAVMERVKGPDFPTHGLIVGSQGIEDTYKTGRGSVKMRGVVEIEEDSRGRTGIVITELPYQVNHDNFITSIAEQVRDGKLAGISNIEDQSSDRVGLRIVVELKRDAVAKVVLNNLYKHTQLQTSFGANMLSIVDGVPRTLRLDQMIRYYVEHQLDVIVRRTRYRLRKANERAHILRGLVKALDALDEVIALIRASQTVDIARAGLIELLDIDEIQAQAILDMQLRRLAALERQRIVDDLAKIEAEIADLEDILAKPERQRAIVRDELKEIADKYGDDRRTRIVPADGEVSDEDLIAREDVVVTITETGYAKRTKTDLYRSQKRGGKGVQGAGLKQDDIVNHFFVCSTHDWILFFTTQGRVYRAKAYELPEASRTARGQHVANLLAFQPNERIAQVIQIKSYEDAPYLVLATRNGLVKKSRLTDFDSNRSGGIVAVNLRDGDELVGAVLCSSEDDLLLVSAKGQSIRFSATDEALRPMGRATSGVQGMRFNADDELLSLNVVRPDTYLLVATSGGYAKRTSIEEYTAQGRGGKGILTIQYDRRRGNLVGALIVDDDTELYAITSGGGVIRTAARQVRKAGRQTKGVRLMNLGEGDTLIAIARNAEAGDSTDEVNTDPDAV

SEQ ID NO: 1080 - protein, 227 aa, Mycobacterium species MCS; identical to SEQ ID NO: 1078
  Msp-MCS DnaB C-extein

SEQ ID NO: 1081 - protein, 706 aa, Mycobacterium species MCS; identical to SEQ ID NO: 1079
  Msp-MCS GyrA C-extein

SEQ ID NO: 1082 - protein, 304 aa, Methanothermobacter thermautotrophicus (Methanobacterium thermoautotrophicum)
  Mth RIR1 C-extein
CGEQPLLTHESCNLGSVNLSLMVGPSGINWEKLRRTIHVAVHFLDNVIDVNSYPLRPVEEMTLRTRKIGLGVMGFADMLIKLGIPYNSVAALEVAGRVMSFISSEARRASMELARERGSFPEFKGSIWDIQGFECMRNATLTTIAPTGSLSIIAGTSSGIEPLFAVSFTRNILGRSFHELHPLFKTMAGRLDKRSLEAIESRGSLRGVPGVPARIRRLFVTAHEIDPVFHVKMQAAFQRYVDNAVSKTVNLPADSSPADVERVFRAAHELGCKGVTVYRYGSKVDEVLRFPEYAGSCRDMTCPN

SEQ ID NO: 1083 - protein, 50 aa, Mycobacterium thermoresistibile
  Mthe RecA C-extein
SPETTTGGKALKFYASVRIDVRRIETLKDGTEAVGNRTRAKIVKNKVSPP

SEQ ID NO: 1084 - protein, 235 aa, Mycobacterium tuberculosis strains H37Rv & CDC1551; identical to SEQ ID NO: 1031
  Mtu SufB (Mtu Pps1) C-extein

SEQ ID NO: 1085 - protein, 59 aa, Mycobacterium tuberculosis, CDC1551; identical to SEQ ID NO: 1030
  Mtu-CDC1551 DnaB C-extein

SEQ ID NO: 1086 - protein, 59 aa, Mycobacterium tuberculosis H37Rv; identical to SEQ ID NO: 1030
  Mtu-H37Rv DnaB C-extein

SEQ ID NO: 1087 - protein, 99 aa, Mycobacterium tuberculosis H37Rv,Also CDC1551; identical to SEQ ID NO: 1032
  Mtu-H37Rv RecA C-extein

SEQ ID NO: 1088 - protein, 99 aa, Mycobacterium tuberculosis So93/sub_species="Canetti"; identical to SEQ ID NO: 1032
  Mtu-So93 RecA C-extein

SEQ ID NO: 1089 - protein, 226 aa, Mycobacterium vanbaalenii PYR-1
  Mvan DnaB C-extein
STLGLDFMRSCSIKHHLPSIVFSLEMSKTEIVMRLLSAEAKIKLADMRSGRMNDDDWTRLARRMSEISEAPLYIDDSPNLTMMEIRAKARRLKQKADLRLVVIDYLQLMTSGKKVESRQQEVSEFSRQIKLLAKELEVPVVAMSQLNRGPEQRTDKKPMLSDLRESGSIEQDADMVILLHRPDAFESDDPRGGEADLIVAKHRAGPTRTITVAHQLHLSRFSNMAK

SEQ ID NO: 1090 - protein, 60 aa, Nocardia farcinica IFM 10152
  Nfa DnaB C-extein
SLEQDADMVILLHRPDAFERDDPRGGEADLIVGKHRNGPTATITVAHQLHLSRFVDMARG

SEQ ID NO: 1091 - protein, 537 aa, Nocardia farcinica IFM 10152
  Nfa RIR1 C-extein
CFLLRIEDNMESIGRSINSALQLSKRGGGVALLLSNIREHGAPIKKIENQSSGVIPIMKLLEDSFSYANQLGARQGAGAVYLHAHHPDIYRFLDTKRENADEKIRIKTLSLGVVIPDITFELAKKNEDMYLFSPYDVERIYGKPFADIDVTEKYYEMVDDKRIRKSKIKAREFFQTIAELQFESGYPYIMFEDTVNRANPIAGKITHSNLCSEILQVSTPSEFNDDLSYAKVGKDISCNLGSLNIAKAMDSPDFAQTIEVAIRALTAVSDQTHITSVPSIEQGNQQSHAIGLGQMNLHGYLARERIHYGSDEGIDFTNMYFYTVVYHALRASNRLAIERGTYFGGFPESKYASGEYFDKYTEQVWEPKTERVRQLFADAGVRIPTQDDWRELKASVMEHGIYNQNLQAVPPTGSISYINHSTSSIHPVASKIEIRKEGKIGRVYYPAPYMTNDNLEYYQDAYEIGYEKIIDTYAAATQHVDQGLSLTLFFKDTATTRDLNKAQIYAWRKGIKTLYYIRLRQMALEGTEVEGCVSCML

SEQ ID NO: 1092 - protein, 8 aa, Neosartorya fischeri
  Nfi PRP8 C-extein
SGFEESMK

SEQ ID NO: 1093 - protein, 8 aa, Neosartorya glabra FRR2163
  Ngl-FR2163 PRP8 C-extein
SGFEESMK

SEQ ID NO: 1094 - protein, 8 aa, Neosartorya glabra FRR1833
  Ngl-FRR1833 PRP8 C-extein
SGFEESMK

SEQ ID NO: 1095 - protein, 367 aa, Natronomonas pharaonis DSM 2160
  Nph CDC21 C-extein
SQLLQYVKNIAPRSVYTSGKGSSSAGLTAAAVRDDFGEGQQWTLEAGALVLADQGIAAVDELDKMRSEDQSAMHQALEQQEISVSKAGINATLKSRCSLLAAANPIHGRFDEYEPFAEQIDLDPPLISRFDLIFTVTDQPDEEEDRQLAEHIIETNYAGELQTHRTKAATSNVSQEQVDSVTEDVAPAIDDELLRKYVAYAKRNCYPTMTEEAKEAIQEFYVDLRLEGQSEDNPVPITARKLEALVRLAEASARIRLSDTATKDDAERVIEIVRSSLEDVGVDPETGELDADIIESGTSKTQRDRIKNIKSLISEVETEYDEGAPIDVVLDRAEEMGMDRSQAEHEIEKLRRQGDVYEPQTDHLRTV

SEQ ID NO: 1096 - protein, 821 aa, Natronomonas pharaonis DSM 2160
  Nph PolB-1 C-extein
SLYPMCMVTINASPETKVDPDNYGAETYAAPNGTHFRKEPDGVIREMVDELLEEREEKKSLRNEHEPSTDAYETYDRQQSAVKVIMNCFTPDTEVLTPDGVRNIRALDIGDEVYSLDPETMEMEVKPVVDTHAYPDYRGELVDIQTGEIDFRVTPNHRMLVRKNGTNGITDDEYRFVEAGALDLATTYELPHDWAGPDGEDVTQIDLTELIDEEYEVWVRPEVHGRTFTAELGWKPRRVPKADIDTVGYVFTADEFKQHREYIESVCEQSYIRRESGLKWIPRVYDGDDFLELLAWYVTEGNAHTSERKEFDGQRHGSSTVQIAQEPVVADGGDTHATIGTLLDRMGFDYDNDNGSYQVTSKLLGDLFCTLGGGGSEDKRIPQLVFEASRRQKERFMQTLISGDGDRQPNSWQYNTASERLRDDVLRLCAHLGVPASYSEESGVYRIYVTEDGTNTLRMDRSAERTTADDGVYCVTVEDNHTLLAGRAGKFQFVGQSLYGVLGWDRFRLYDKEMGAAVTATGRDVIEFTEQAAAELDKDVIYGDTDSVMLELGNEVSEDEAIEQSFEIESHINDAYDRFAERLNAEEHRFQIEFEKLYRRFFQAGKKKRYAGHIIWKEGKEVDDLDITGFEYQRSDIAPITKEVQREVLEMIVTGEDPEDIKSYVHDVIERVREGDISHEELAIPGGIGKKLDNYETDTAQVRGAKYANRLLGTNFTSGSKPKRLYLAKVHPSFFRKMESEEGLDPSTDQLYGEFKREAESGEAVICFEYEDQIPDAFEVDYEKMLDKTLKGPIARVLEALDISWDEVESGQEQTGLGSFM

SEQ ID NO: 1097 - protein, 325 aa, Natronomonas pharaonis DSM 2160
  Nph PolB-2 C-extein
SLYGVLGWDRFRLYDKEMGAAVTATGRDVIEFTEQAAAELDKDVIYGDTDSVMLELGNEVSEDEAIEQSFEIESHINDAYDRFAERLNAEEHRFQIEFEKLYRRFFQAGKKKRYAGHIIWKEGKEVDDLDITGFEYQRSDIAPITKEVQREVLEMIVTGEDPEDIKSYVHDVIERVREGDISHEELAIPGGIGKKLDNYETDTAQVRGAKYANRLLGTNFTSGSKPKRLYLAKVHPSFFRKMESEEGLDPSTDQLYGEFKREAESGEAVICFEYEDQIPDAFEVDYEKMLDKTLKGPIARVLEALDISWDEVESGQEQTGLGSFM

SEQ ID NO: 1098 - protein, 325 aa, Natronomonas pharaonis DSM 2160
  Nph rPol A'' C-extein
TMNTFHYAGVAEIDVTQGLPRLIELVDARKTPDTPMMTVHLEGEYARDRERAHEVVWKIEATKILALGDVSTNVADMLVQIDLNEETLAERWPTMESIDDIAGRIAGTIEGELGVDTARPKPTVIEFGPEEPSYRQLLQLVEELREIVFKGIEEINRVVIRKEETEQGEEFVLYTEGSDLKEVLDIEGVDASRTTCNNIHEIHNNLGIEAAREAIIEETMNTLEEQGLDDVNIRHLMLVADIMTNNGEIESIGRHGISGNKDSVLARAAFEVTVNHLLDAAIHGEVDDLDGVTENVIVGKPIKLGTGDVDLRMGATRDSGSRADD

SEQ ID NO: 1099 - protein, 316 aa, Nostoc punctiforme
  Npu GyrB C-extein
CGMSAIKTSFTAEQLEGKLKKIRLDIEAAIPTGFNENKDVEKSVSNWQHWDDFKDLHRGVQDLQGKAMKQMGSLGGGNHFIEVCLDTENQVWLMLHSGSRNIGNKLAQCHIYTARELAKMAGNKLPDPDLAHFVAGTREFQAYWHDLQWSQNYARVNRDVMMARFKHIVEKHLVGGKATKPLLQVNCHHNYAEKEVHFDEDVYVTRKGAVRAQTEDYGIIPGSMGAKSFIVKGKGNAHSFCSCSHGAGRLMSRNKAKNVYTLDDLIEQTNGVECRKDEGVLDEIPGAYKPIEQVMANQADLVEVVATLKQVLCVKG

SEQ ID NO: 1100 - protein, 8 aa, Neosartorya quadricincta, strain NRRL 4175
  Nqu PRP8 C-extein
SGFEESMK

SEQ ID NO: 1101 - protein, 226 aa, Nocardioides species JS614
  Nsp-JS614 DnaB C-extein
STLALDLCRAASIHNNLTSVFFSLEMTRSEITMRLLSAEAKVPLNHIRNGNMNDDDWAKLARKMGEVSSAPMFIDDSPNMTMMEIRAKARRLKQRHDLRLVVIDYMQLMTSGRKVESRQLEVSEFSRQIKLLAKELEVPIIALSQLNRGPEQRGDKRPMMSDLRESGSLEQDADMVILLHRDDVYEKESTRPGEADLIVAKHRNGPTRDITVAFQGHYSRFVDMAH

SEQ ID NO: 1102 - protein, 559 aa, Nocardioides species JS614
  Nsp-JS614 TOPRIM C-extein
CFGCSEGGNVITFLMKIDGLTFGEAVERLADKVGVQLRREEGDVREERPKGPPRRRLVEAHKVAQEYYADQLATPDALVARQFLGGRGFDQAAAEHFGIGFAPRDGDALKTHLRQKGFSAEEMTVGGLIGPSGYDRFRGRLLWPIRDASGDTIGFGARRIFDDDRIDAKYLNTSETPIYKKSQVLYGIDLARRDIGRSSQAVIVEGYTDVMACHLSGVTTAVATCGTAFGDDHSRVLRRFLNDHQVTHGEIIFTFDGDAAGQKAALRAFGGDQNFVSQTYVAVEPGGLDPCDLRIQQGDAAVRELVARRVPLYRFVLTNVVREFDLDRADGRIAAVREAAKLVLSSRDNSVAQSSFARDISELTGVDPNEVLVEVRRVVARHRNGDRGAVAEPPTNRSAVPSLHDPRFAIERETLQLVIQHPMTIGRSTGDIGPNDFVHPTYRAVWELVAAAGGPGAGAGDPSWANRLRDAATDPAASSVISALAVEPLKKEPDAAYVAEHVFRLLELTAARRIAAIKSKLQRTNPVEHAEEFNKMFGELAALEAHRRALRDRLAGSAT

SEQ ID NO: 1103 - protein, 490 aa, Nostoc species PCC7120, (Anabaena sp. PCC7120)
  Nsp-PCC7120 RIR1 C-extein
SAGMRQFISDDQLGAAAKDNLWQQDENGRWRIDPERDSLRMANHTRVFHRKPTLEECVDAVRKQYYSGEGAIQWAGEAVARANIDLLPTQALKVEFLKAYEQGTAKDWLQKRHPHFDEKELKHRLARYALNPCGEIIGSNFHCNLSEIHLNQIDPFNYKEQEEAFTAGALSVATLLNHKFPEPRYQYSRELDPIVGVSFTGLFDFFVHAFGAEWLQWWEAGRPATPQGLAFKREEEKYLSSWREIVQRVVWDYCDRHNIKRPNRCTTVQPSGTKSLLTGASPGWHPPKAQRFIRRITFRKNDPVALACIDYGYNVIPSQSDKDEQGNLLNDPLDPRVSEWLVEIPVAVSWADIPGADTIDISKFNAIAQMDFYMQVQKFYVTHNTSATIEVREHEVETLGTQIWQAIQNDEGYISAALLARFDDHQTFPRLPFEPISKEQYEQMVKEVVQRRKTDDFYAVLSRYDFGDLMEVGPAGCDSDKCMMPEQSPN

SEQ ID NO: 1104 - protein, 614 aa, Pyrococcus abyssi
  Pab CDC21-1 C-extein
SQLLRYIANLAPRAIYTSGKSSSAAGLCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNTAAVVRDEFTGGWVLEAGALVLADGGYALIDELDKMNDKDRSVIHEALEQQTISLSKAGITATLNARTTVIAAANPKQGRFNRMKRISEQINLPPTLMSRFDLIFVLVDEPDEKIDSEIARHILRVRRGESEVVTPKIPHDLLRKYIAYARKNVHPVISEEAMEEIEKYYVKMRKSVKKSSEEEIKPIPITARQLEALIRLSEAHARMRLSPIVTREDAREAIKLMEYTLRQIAVDETGQIDVTILEVGQSARKLSKVERILDIIEKLEGTSEKGAKIDDILEEAKKFGIEKQEAREILEKLLEQGQIYMPENGYYRTV

SEQ ID NO: 1105 - protein, 319 aa, Pyrococcus abyssi
  Pab CDC21-2 C-extein
TAAVVRDEFTGGWVLEAGALVLADGGYALIDELDKMNDKDRSVIHEALEQQTISLSKAGITATLNARTTVIAAANPKQGRFNRMKRISEQINLPPTLMSRFDLIFVLVDEPDEKIDSEIARHILRVRRGESEVVTPKIPHDLLRKYIAYARKNVHPVISEEAMEEIEKYYVKMRKSVKKSSEEEIKPIPITARQLEALIRLSEAHARMRLSPIVTREDAREAIKLMEYTLRQIAVDETGQIDVTILEVGQSARKLSKVERILDIIEKLEGTSEKGAKIDDILEEAKKFGIEKQEAREILEKLLEQGQIYMPENGYYRTV

SEQ ID NO: 1106 - protein, 578 aa, Pyrococcus abyssi
  Pab IF2 C-extein
TTLLDRIRKTNVAAKEAGGITQHIGATEVPIEVVKKIAGPLIKLWKAEIKLPGLLFIDTPGHEAFTSLRARGGSLADLAVLVVDINEGFQPQTIESIEILRKYRTPFVVAANKIDRIKGWVIEEDEPFLMNIKKQDQRAVQELETKLWELIGKFYEFGFQANRFDRVQNFTRELAIVPISAKYGIGIAELLVLIAGLSQRYLEEKLKIEVEGPARGTILEVREEPGLGHTIDVIIYDGTLHKDDTIVVGGKDKAIVTKIRALLKPKPLDEIRDPRFRFDYVDEVTAAAGVKIAAPGLEEALAGSPVIAAPTPEDVEKAKQEILEQIERVVISTDKVGVIVKADTLGSLEALSKELQEKEIPIRKADVGNVSKTDVMEALSVKEEEPKYGVILGFNVKVNEDAEEVAKAKDVKIFVGNVIYKLIEDYEEWVKEEEEKKKRELLSKVTFPGVIRLYPDERYVFRRSNPAIVGIEVIEGRIKPGVTLIKQNGQKVGVIRSIKSRDEFLQEAKKGQAVAIAIEGAIVGRHIHPGETLYVDLSRDDAITLLKHLRDTLEDTDIKALKMIAKVKAKEDPFWRAI

SEQ ID NO: 1107 - protein, 165 aa, Pyrococcus abyssi
  Pab KlbA C-extein
CMGTIHSNSARETIIRLESPPMNVPKIMIPALDIIIMQVRYHTRKKGTIRRVTEIAEVSGIEGESIQLNFLYKYDPAKDELVRTEVPSRFLQILSYHTGMSLEEIHLEIEKRKLVLDWMIEKGLRRIDEVGAQIREFYIDEEEFFKKIQREAATMEISRRVKEFI

SEQ ID NO: 1108 - protein, 445 aa, Pyrococcus abyssi
  Pab Lon C-extein
SGGLGTPAHLRVEPGMIHRAHKGVLFIDEIATLSLKMQQSLLTAMQEKKFPITGQSELSSGAMVRTEPVPCDFILVAAGNLDTIEKMHPALRSRIRGYGYEVYMRTTMPDTVENRRKLVQFVAQEVKKDGRIPHFTRDAVEEIIREAQRRAGRKGHLTLRLRDLGGVVRAAGDIAVRKGKKYVTREDVLEALQMAKPLEKQLADWYIERKKEYQVIRTEGGEIGRVNGLAIIGEQSGIVLPIEAIVAPAASKEEGKIIVTGKLGEIAREAVLNVSAIIKRYKGEDISRYDIHVQFLQTYEGVEGDSASISVATAVISALEEIPVRQDVAMTGSLSVRGEVLPVGGVTPKIEAAIEAGIKKVIIPKANEKDVFLSPDKREKIEIIPVERIDEVLEVALVESEKKKELIKRIRETLPLGVSESAGSETLHEHGRDSGSALSVEESKA

SEQ ID NO: 1109 - protein, 432 aa, Pyrococcus abyssi
  Pab Moaa C-extein
CFFYAREGEPIYEPTLEQIRMMLRNAKKEHPIGANAVQFTGGEPTLRDDLIEIIKIAKEEGYDHVQLNTDGIKLAFDPELVKKIRQAGVNTLYLSYDGMTPQTNWKNHWEIPLIFENVRKAGGPGIVLVPTLIRNVNDHEAGAIINFGLNHLDIVRGVNFQPISLVGRVPKKERQRFRITIAGAIKKIEEQTNGVISKDDWYPIPIAGHIARFFEVFTGSKYYMTSHFACGAATYVFLDREEKKVIPIPRFLDVEGFVEFLLEKAEEIEKARFKGLAKLKAIGETVFIKFKQFYDEKNAPKGLDVLGLIKNAFVHGNYDALGKFHMNTLFLGMMHFMDEYNYDVERVERCVIHYAMPDGRIVPFCTFNVIPELYRDKVQRQFSYSWEEWKKLHPDWDYMKDKYVRTKEFVEKMKKSELYRKTYIDIVNYFER

SEQ ID NO: 1110 - protein, 316 aa, Pyrococcus abyssi
  Pab Pol-II C-extein
CDGDEDAVMLLLDALLNFSRYYLPEKRGGKMDAPLVITTRLDPREVDSEVHNMDIVRYYPLEFYEATYELKSPKELVGVIERVEDRLGKPEMYYGLKFTHDTDDIALGPKMSLYKQLGDMEEKVRRQLEVAKRIRAVDEHGVAEKILNSHLIPDLRGNLRSFTRQEFRCVKCNTKFRRPPLNGKCPVCGGKIVLTVSKGAIEKYLGTAKMLVTEYNVKNYTRQRICLTERDIDSLFENVFPETQLTLIVNPNDICQRLVMARTGEVNKSGLLENLSNGSKKTEKAEKAEKPRKKSDEKPKKKRVISLEEFFSRKSK

SEQ ID NO: 1111 - protein, 877 aa, Pyrococcus abyssi
  Pab RFC-1 C-extein
TTAALALARELFGENWRHNFLELNASDERGINVIREKVKEFARTKPIGGASFKIIFLDEADALTQDAQQALRRTMEMFSSNVRFILSCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNCNYSSKIIEPIQSRCAIFRFRPLNDEDIAKRLRYIAENEGLELTEEGLQAILYIAEGDMRRAINILQAAAALDRKITDENVFLVASRARPEDIREMMLLALKGNFLKAREKLREILLKQGLSGEDVLVQMHREVFNLPIDEPMKVYLADKIGEYNFRLVEGANEMIQLEALLAQFTLIGKKK

SEQ ID NO: 1112 - protein, 182 aa, Pyrococcus abyssi
  Pab RFC-2 C-extein
CNYSSKIIEPIQSRCAIFRFRPLNDEDIAKRLRYIAENEGLELTEEGLQAILYIAEGDMRRAINILQAAAALDRKITDENVFLVASRARPEDIREMMLLALKGNFLKAREKLREILLKQGLSGEDVLVQMHREVFNLPIDEPMKVYLADKIGEYNFRLVEGANEMIQLEALLAQFTLIGKKK

SEQ ID NO: 1113 - protein, 1422 aa, Pyrococcus abyssi
  Pab RIR1-1 C-extein
TGLNFSKLRPEGDIVGTTTGAACFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNSGPVSFMHLIDAVSDVIKQGGVRRGANMGILEIWHPDIEKFIHAKEKNIGTNVLSNFNISVGIWEDFWEALKEGKKYPLINPRTGEVVKEIDPKTLFEELAYMAWAKADPGVIFFDIINRRNVLKEAKGGPIRATNPCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNCGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSIEAAKKRGTFPLYEKTGYPKGELPVEGFYHPEIWNLPWDKLVEEIKKYGVRNAMVTTCPPTGSVSMIADTSSGIEPIFALVYKKSVTVGEFYYVDPVFEAELKRRGLYSEELLKKISDNYGSVQGLEEIPEDMRRVFVTALDIHWLDHLLAQANIQMWLTDSASKTINMINEATVEDVKAAYLIAHFLGCKGVTVYRDGSLSVQVYSVEGEKKRRYKPKPSEYAKKVLLEIVEKEPWIKNFINVDEILNGKRQELNFSLTGLKRETHEVKKVEVKQQNNKIPEEKIKELLGVVYCPVCYEREGKLVELRMESGCATCPVCGWSKCVIS

SEQ ID NO: 1114 - protein, 962 aa, Pyrococcus abyssi
  Pab RIR1-2 C-extein
SGPVSFMHLIDAVSDVIKQGGVRRGANMGILEIWHPDIEKFIHAKEKNIGTNVLSNFNISVGIWEDFWEALKEGKKYPLINPRTGEVVKEIDPKTLFEELAYMAWAKADPGVIFFDIINRRNVLKEAKGGPIRATNPCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNCGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSIEAAKKRGTFPLYEKTGYPKGELPVEGFYHPEIWNLPWDKLVEEIKKYGVRNAMVTTCPPTGSVSMIADTSSGIEPIFALVYKKSVTVGEFYYVDPVFEAELKRRGLYSEELLKKISDNYGSVQGLEEIPEDMRRVFVTALDIHWLDHLLAQANIQMWLTDSASKTINMINEATVEDVKAAYLIAHFLGCKGVTVYRDGSLSVQVYSVEGEKKRRYKPKPSEYAKKVLLEIVEKEPWIKNFINVDEILNGKRQELNFSLTGLKRETHEVKKVEVKQQNNKIPEEKIKELLGVVYCPVCYEREGKLVELRMESGCATCPVCGWSKCVIS

SEQ ID NO: 1115 - protein, 443 aa, Pyrococcus abyssi
  Pab RIR1-3 C-extein
CGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSIEAAKKRGTFPLYEKTGYPKGELPVEGFYHPEIWNLPWDKLVEEIKKYGVRNAMVTTCPPTGSVSMIADTSSGIEPIFALVYKKSVTVGEFYYVDPVFEAELKRRGLYSEELLKKISDNYGSVQGLEEIPEDMRRVFVTALDIHWLDHLLAQANIQMWLTDSASKTINMINEATVEDVKAAYLIAHFLGCKGVTVYRDGSLSVQVYSVEGEKKRRYKPKPSEYAKKVLLEIVEKEPWIKNFINVDEILNGKRQELNFSLTGLKRETHEVKKVEVKQQNNKIPEEKIKELLGVVYCPVCYEREGKLVELRMESGCATCPVCGWSKCVIS

SEQ ID NO: 1116 - protein, 383 aa, Pyrococcus abyssi
  Pab RtcB (Pab Hyp-2) C-extein
CGVRLIRTNLTEKDVRPRIKQLVDTLFKNVPSGVGSQGRVRLHWTQIDDVLVDGAKWAVDNGYGWEEDLERLEEGGRMEGADPDAVSQRAKQRGAPQLGSLGSGNHFLEVQVVDKIFDPEVAKVYGLFEGQVVVMVHTGSRGLGHQVASDYLRIMERAIRKYRIPWPDRELVSVPFQSEEGQRYFSAMKAAANFAWANRQMITHWVRESFQEVFRQDPEDLGMSIVYDVAHNIGKVEEHEVDGKKVKVIVHRKGATRAFPPGHEAIPKIYRDVGQPVLIPGSMGTASYVLAGTEGAMKETFGSTCHGAGRVLSRKAATRQYRGDRIRQELLNRGIYVRAASMRVVAEEAPGAYKNVDNVVKVVSEAGIAKLVARMRPIGVAKG

SEQ ID NO: 1117 - protein, 348 aa, Pyrococcus abyssi
  Pab VMA C-extein
TVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNVDPEWKAMRDKAMELLQKESELQEIVRIVGPDALPERERAILLVARMLREDYLQQDAFDEVDTYCPPEKQVTMMRVLLNFYDKTMEAISRGVPLEEIAKLPVREEIGRMKFEPDVGKIKALIDKTNEQFEELFKKYGA

SEQ ID NO: 1118 - protein, 165 aa, Pyrococcus furiosus
  Pfu KlbA C-extein
CMGTIHANSARETIIRLESPPMSVPRIMIPALDIIIMQVRYHSRKKGTLRRITEIAEVSGIEGESIQLNFLYKYDPAKDELIRTEVPSRFIQTLSYHTGLSIEELKWEIEKRRLILDWMIEKGIRRIDEVGYYIKEFYIDEEELLKKIEREAETIETSKRAKEFI

SEQ ID NO: 1119 - protein, 985 aa, Pyrococcus furiosus
  Pfu RIR1-1 C-extein
TGLNFSKLRPEGDIVGTTTGAASGPVSFMHLIDAVSDVIKQGGVRRGANMGILEIWHPDIEKFIHAKEKNIGTNVLSNFNISVGIWEDFWEALKEGKKYPLINPRTGEVVKEVDPKTLFEELAYMAWAKADPGVIFFDVINRRNVLKKAKGGPIRATNPCVVGDTRILTPEGYLKAEEIFSLAKERGKKEAVAVEGIAEEGEPYAYSVEILLPGEEKVEYETVHGKVLAVADPVAVPAYVWKVGRKKVARVKTKEGYEITATLDHKLMTPEGWKEVGKLKEGDKILLPRFEVEEEFGSESIGEDLAFVLGWFIGDGYLNVNDKRAWFYFNAEKEEEIAVRIRDILVKHFGIKAELHRYGNQIKLGVRGEAYRWLENIVKNNEKRIPEIVYRLKPREIAAFLRGLFSADGYVDKDMAIRLTSKSRELLREVQDLLLLFGILSKIYEKPYESEFHYTTKNGEERIYRSKGYYELVITNYSRKLFAEKIGLEGYKMEKLSLKKTKVDQPIVTVESVEVLGEEIVYDFTVPNYHMYISNGFMSHNCGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSVEAAKKRGTFPLYDKTEYPEGKLPVEGFYHPEIWNLPWDKLVEEIKKYGLRNAMVTTCPPTGSVSMIADTSSGIEPVYALVYKKSVTVGEFYYVDPVFEEELKKRGLYSEELLKKISDNYGSVQGLEEIPEDMQRVFVTALDIHWLDHIIAQASIQMWLTDSASKTINMINEATVEDVKAAYLIARFLGCKGVTVYRDGSLSVQVYSVEGEKKKRRFKPKPSEYAKKILLEIVEKEPWIKNFINVDEILNGKKEQLLFSLRPANESKLKVPGREEEVRPGNIPEEKIRELLGVVYCPVCYEKEGKLVELKMESGCATCPVCGWSKCVIS

SEQ ID NO: 1120 - protein, 444 aa, Pyrococcus furiosus
  Pfu RIR1-2 C-extein
CGEEPLYEYESCNLASINLAKFVKYDENGKPYFDWDEYAYVIQKVAKYLDNSIDVNKFPLPEIDYNTKLTRRIGVGMMGLADALFKLGIPYNSEEGFKFMRKVTEYLTFYAYKYSVEAAKKRGTFPLYDKTEYPEGKLPVEGFYHPEIWNLPWDKLVEEIKKYGLRNAMVTTCPPTGSVSMIADTSSGIEPVYALVYKKSVTVGEFYYVDPVFEEELKKRGLYSEELLKKISDNYGSVQGLEEIPEDMQRVFVTALDIHWLDHIIAQASIQMWLTDSASKTINMINEATVEDVKAAYLIARFLGCKGVTVYRDGSLSVQVYSVEGEKKKRRFKPKPSEYAKKILLEIVEKEPWIKNFINVDEILNGKKEQLLFSLRPANESKLKVPGREEEVRPGNIPEEKIRELLGVVYCPVCYEKEGKLVELKMESGCATCPVCGWSKCVIS

SEQ ID NO: 1121 - protein, 348 aa, Pyrococcus furiosus
  Pfu VMA C-extein
TVTQHQLAKWSDAQVVVYIGCGERGNEMTDVLEEFPKLKDPNTGKPLMERTVLIANTSNMPVAAREASIYTGITIAEYFRDMGYDVALMADSTSRWAEALREISGRLEEMPGEEGYPAYLASRLAEFYERAGRVVTLGSDYRVGSVSVIGAVSPPGGDFSEPVVQNTLRVVKVFWALDADLARRRHFPAINWLTSYSLYVDAVQDWWHKNVDPEWRRMRDKAMELLQKEAELQEIVRIVGPDALPERERAILLVARMLREDYLQQDAFDEVDTYCPPQKQVTMMRVLMTFYERTMDAISRGVPLEEIAKLPVREEIGRMKFEPDIEKIRALIDKTNEQFDELLKKYGA

SEQ ID NO: 1122 - protein, 606 aa, Pyrococcus horikoshii OT3
  Pho CDC21-1 C-extein
SQLLRYVANLAPRAIYTSGKSSSAAGLCVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHNTAAVVRDEFTGGWVLEAGALVLADGGYALIDELDKMSDRDRSVIHEALEQQTISLSKAGITATLNARTTVIAAANPKHGRFNRMKRVSEQIDLPPTLLSRFDLIFVLMDEPDEKVDSEIARHILKVRRGESEVVTPKIPHELLRKYIAYARKNIHPVISEEAMEEIEKYYVKMRRSAKKSSGDEIKPIPITARQLEALIRLSEAHARMRLSPIVTREDAREAIKLMEYTLKQIAVDEAGQLDVTILEVGQSARKLSKVERILDIVEKLERTSEKGAKIDDILEEAAKFGIEKSEAREILEKLLEKGQIYMPENGYYKTV

SEQ ID NO: 1123 - protein, 319 aa, Pyrococcus horikoshii OT3
  Pho CDC21-2 C-extein
TAAVVRDEFTGGWVLEAGALVLADGGYALIDELDKMSDRDRSVIHEALEQQTISLSKAGITATLNARTTVIAAANPKHGRFNRMKRVSEQIDLPPTLLSRFDLIFVLMDEPDEKVDSEIARHILKVRRGESEVVTPKIPHELLRKYIAYARKNIHPVISEEAMEEIEKYYVKMRRSAKKSSGDEIKPIPITARQLEALIRLSEAHARMRLSPIVTREDAREAIKLMEYTLKQIAVDEAGQLDVTILEVGQSARKLSKVERILDIVEKLERTSEKGAKIDDILEEAAKFGIEKSEAREILEKLLEKGQIYMPENGYYKTV

SEQ ID NO: 1124 - protein, 578 aa, Pyrococcus horikoshii OT3
  Pho IF2 C-extein
TTLLDKIRKTNVAAKEAGGITQHIGATEVPIDVVKKIAGPLIKLWKAEIRLPGLLFIDTPGHEAFTSLRARGGSLADLAVLVIDVNEGFQPQTIESIEILRRYRTPFVVAANKIDRIRGWVIEEDEPFLMNIKRQDQRAIQELETKLWELIGKFYEFGFQANRFDRVQNFTRELAIVPISAKYGIGIAELLVLIAGLSQKYLEEKLKIEVEGPARGTILEVREEPGLGHTIDVIIYDGTLHKDDTIVVGGKDKAIVTKVRALLKPKPLDEIRDPRFRFDYVDEVTAAAGVKIAAPGLEEALAGSPVIAAPTPEDVERAKEEIMRQIESVVISTDKVGVIVKADTLGSLEALSKELQEKEIPIRKADVGNISKTDVMEALSVKEENPKYGVILGFNVKVNEDAKEVAKAKEVPIFVGNIIYKLIEDYEAWIKEEEEKRKRELLAKVTFPGVIKLYPDERYVFRRSNPAIVGIEVLEGRIKPGVTLIKQNGQKVGTIRSIKSRDEFLQEARKGQAVAIAIEGAIVGRHIHPGETLYVDLSRDDAIILLKHLRDVLEDTDIKALKMIAQVKAKEDPFWRAV

SEQ ID NO: 1125 - protein, 165 aa, Pyrococcus horikoshii OT3
  Pho KlbA C-extein
CMGTIHSNSARETIIRLESPPMNVPRIMIPALDIIIMQVRYHTRKKGTIRRMTEIAEVSGIEGESIQLNFLYKYDPAKDEIVRTEVPSRFLNILSYHTGMGMDELYYEIEKRKLVLDWMIEKGIRRIDEVGAQIREFYIDEEEFFKKLEREATTIEMSKRVKEFI

SEQ ID NO: 1126 - protein, 531 aa, Pyrococcus horikoshii OT3
  Pho LHR C-extein
SSTSLELGIDIGTIDLVVLVGSPKSVNRALQRIGRAGHRLHEVSRGIILALDRDDLVEVTVLAHNARNRKLDRIKIPKNPLDVLVQHILGMALEKVWEIEEAYRVVRRAYPYHELPFSDFMNVLKYLAGEYSGLEEKRVYAKIWLENGKFGRRGKMTRAIYYMNTGTIPDEAKIDVFTLDKKYIGTVEEEFAERLMPGDIFVLAGRTYEFVKSRGNKIYVIPREGAKPTIPSWFSEMLPLSFDLAIDIQRFRGEVKKLLTSKRAESLLMKKYGIDNVTAKAIISYFREQAKYSIIPDDETVLVEIVREGNVTKYFFHTLIGRRANDALSRAFAYMISKKKKCNVGIAITDNGFMLKVPVDKELKEGEILELFYVENLREILKRALDNTELLKRRFRHVANRGLLILRRYMGREKSLSRQQMNAQTLLNFLKKNHPNFPLLKEVYREIMEDKMDIENAELFLKWIKEGKIKVTVREHPYPSPFAFNLEVIGASDVVLMEDRRELIKELHKKIMAIIKGVPSPTAPRSPITGV

SEQ ID NO: 1127 - protein, 443 aa, Pyrococcus horikoshii OT3
  Pho Lon C-extein
SGGLGTPAHLRVEPGMIHRAHKGVLFIDEIATLSLKMQQSLLTAMQEKKFPITGQSELSSGAMVRTEPVPCDFILVAAGNLDTIEKMHPALRSRIRGYGYEVYMRTTMPDTPENRRKLVQFVAQEVKKDGRIPHFTRDAVEEIVREAQRRAGRKGHLTLRLRDLGGVVRAAGDIAVRKGKKYVTREDVLEALKLAKPLEKQLADWYIERKKEYQVIRVEGGEIGRVNGLAIIGEQSGIVLPIEAIVAPAASKEEGKIIVTGKLGEIAKEAVLNVSAIIKRYKGEDISKYDIHVQFLQTYEGVEGDSASISVATAVISALEEIPVRQDVAMTGSLSVRGEVLPVGGVTPKIEAAIEAGIKTVIIPKSNEKDVFLSPDKRKKIKIIPVERIDEVLEVALVESEKKRELIKRVRESLPLWMEETPSGETLHEHKGGATLPLEESKA

SEQ ID NO: 1128 - protein, 283 aa, Pyrococcus horikoshii OT3
  Pho Pol I C-extein
SYYGYYGYAKARWYCKECAESVTAWGRQYIDLVRRELEARGFKVLYIDTDGLYATIPGVKDWEEVKRRALEFVDYINSKLPGVLELEYEGFYARGFFVTKKKYALIDEEGKIVTRGLEIVRRDWSEIAKETQARVLEAILKHGNVEEAVKIVKDVTEKLTNYEVPPEKLVIYEQITRPINEYKAIGPHVAVAKRLMARGIKVKPGMVIGYIVLRGDGPISKRAISIEEFDPRKHKYDAEYYIENQVLPAVERILKAFGYKREDLRWQKTKQVGLGAWIKVKKS

SEQ ID NO: 1129 - protein, 314 aa, Pyrococcus horikoshii OT3
  Pho Pol-II C-extein
CDGDEDAVMLLLDALLNFSRYYLPEKRGGKMDAPLVITTRLDPREVDSEVHNMDIVRYYPLEFYEATYELKSPKELVGVIERVEDRLGKPEMYYGLKFTHDTDDIALGPKMSLYKQLGDMEEKVKRQLDVARRIRAVDEHKVAETILNSHLIPDLRGNLRSFTRQEFRCVKCNTKFRRPPLDGKCPICGGKIVLTVSKGAIEKYLGTAKMLVTEYKVKNYTRQRICLTERDIDSLFETVFPETQLTLLVNPNDICQRIIMERTGGSKKSGLLENFANGYNKGKKEEMPKKQRKKEQEKSKKRKVISLDDFFSRK

SEQ ID NO: 1130 - protein, 261 aa, Pyrococcus horikoshii OT3
  Pho r-Gyr C-extein
CTYHRTDSIHVSNTGIEVAKEYITQEIGEEYFTPRKWGEEGAHEAIRPTRPIDTGRLIQLIRDGIITIPKNLTRDHFRLYDLIFRRFMASQMKPAKILYEKAIISTPFKDVEVEGYIDVLYDGWSKIKSLPLRQIPKLEKGQRLRVKEVKQWRAPKVSLYTQGDVIALMKERGIGRPSTYAKIVQTLLQRGYVIETKGKKKLVPTEKGIKVYQYLITKYKDLVSEERTRQLEKIMDMVEEAKADYQDVLNELYEEIKRYVR

SEQ ID NO: 1131 - protein, 205 aa, Pyrococcus horikoshii OT3
  Pho RadA C-extein
TQLAHTLAVMVQLPPEEGGLNGSVIWIDTENTFRPERIREIAKNRGLDPDEVLKHIYVARAFNSNHQMLLVQQAEDKIKELLNTDKPVKLLIVDSLTSHFRSEYIGRGALAERQQKLAKHLADLHRLANLYEIAVFVTNQVQARPDAFFGDPTRPIGGHILAHSATLRVYLRKGKGGKRVARLIDAPHLPEGEAVFRITEKGIED

SEQ ID NO: 1132 - protein, 269 aa, Pyrococcus horikoshii OT3
  Pho RFC C-extein
TTAALALSRELFGENWRHNFLELNASDERGINVIREKVKEFARTKPIGGASFKIIFLDEADALTQDAQQALRRTMEMFSSNVRFILSCNYSSKIIEPIQSRCAIFRFRPLRDEDIAKRLRYIAENEGLELTEEGLQAILYIAEGDMRRAINILQAAAALDKKITDENVFMVASRARPEDIREMMLLALKGNFLKAREKLREILLKQGLSGEDVLIQMHKEVFNLPIDEPTKVYLADKIGEYNFRLVEGANEMIQLEALLAQFTLVGKKK

SEQ ID NO: 1133 - protein, 439 aa, Pyrococcus horikoshii OT3
  Pho RIR1 C-extein
CGEEPLYEYESCNLASINLAKFVKYDENGKPYFDWDEYAYVIQKVTKYLDNAIDVNKFPLPEIDHNTKLTRRIGVGMMGLADALFKLGIPYNSEEGFKFMRKVTEYLTFYAYKYSVEAAKRRGTFPLYEKTEYPKGKLPVEGFYHPEIWNLPWDKLVEEIKKYGLRNAMVTTCPPTGSVSMIADTSSGIEPIYALVYKKSVTVGEFYYVDPVFEAELKKRGLYSEELLKKISDNYGSIQGLEEIPEDMKRVFVTALDIHWLDHLLAQASIQMWLTDSASKTINMINEATVEDVKAAYLIAHFLGCKGVTVYRDGSLSVQVYSVEGEKKKRKYKPKPSEYAKKVFLEIVEKEPWIKNFINVDEILNGKRESNLTFSLSIKKEHQEKPQENKGIPEEKIKELLGVVYCPVCYEREGKLVELRMESGCATCPVCGWSKCVIS

SEQ ID NO: 1134 - protein, 348 aa, Pyrococcus horikoshii OT3
  Pho VMA C-extein
TVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNIDPEWKAMRDKAMALLQKESELQEIVRIVGPDALPERERAILLVARMLREDYLQQDAFDEVDTYCPPEKQVTMMRVLLNFYDKTMEAINRGVPLEEIAKLPVREEIGRMKFERDVSKIRSLIDKTNEQFEELFKKYGA

SEQ ID NO: 1135 - protein, 698 aa, Pelodictyon luteolum DSM 273
  Plut RIR1 C-extein
CSEYMFLDNTACNLASLNLIHFVDEESGHVKINELRHAAALWTVVLEISVLMAHFPSPDIARLSYEYRTLGLGFANLGTVLMVLGIPYDSPKALALAGAISAIITGQAYVTSAEISRDLGPFDGYQANSKEMLRVIRNHRRAARNESEEEYEELSVKPRGIDSEYCPKELFEAAGSVWDEALQKGKKYGFRNAQVSVIAPTGTIGLVMDCDTTGIEPEFAIVKFKKLAGGGYFKIVNQSVHKALKRLGYAAQEIEEIEKYCKGSGSLEGCPSINSQWLMNRGFTEEKIALLESNLAAVFDIRFAFNKWILGEEFCQSLGFTEAQLNDPGFDMLQALGASAEDAEAANDFICGTMTIEGAPHLKLEHLPVFDCASRCGQKGLRFINHMAHVRMMSSVQPFISGAISKTVNMPATATTAEIGEVYLSGWQHMVKAITVYRDGSKLSQPLNISSYQDLDEVIMLGNEEDLDETKGPREVQERIIERVYHRSERRLLPKRRKGFIREAYVGGHKVFLRTGEYEDGSLGEVFIDMYKEGASFKGLLNCFAVLASKALQYGMPLEELVDSFTFTRFEPAGAVQGHNAIKNSTSILDYVFRSIGYDYLGRKDFVHVKAVDEVPEHGADAKNSNGQTSPVAALEAEAVPAAHHAGSEYTNTLKSQVMQAKVQGYTGEQCENCGSMRVKQNGTCKVCEDCGMTTGCS

SEQ ID NO: 1136 - protein, 513 aa, Polaromonas naphthalenivorans CJ2
  Pna RIR1 C-extein
CGEQPLPPYGCCDLGPIILTRFVRHPFGFGGEPEFDFEAFEASVATQVRALDNVLEVTFWPLPQQQTESSAKRRIGVGFTGLGNALAMLRLRYDAPEGRDMAARIAVRMRDAAYAASSELAKEKGAFPKFDANGYLATGTFASRLPAALQQAIRAHGIRNSHLLSIAPTGTVSLAFADNASNGIEPAFSWMYKRKKRESDGSTTEYAVEDHAWRLYRELGGDVNKLPGYFVSALDMSATSHIAMMQAVQPFIDTAISKTVNVPADYPYGDFKSLYHQAWRAGLKGLATYRPNAILGAVLETHASPDATPAAAAPAPMDPMRTVIESRPKGALSAVAEKVEYWTQEGHKTLYIVVSFLPVPSASGSGTVERAIEFFMPVGQSGESQQWITSSMRMLSLAARGGFLERALSDMRKVAWDRGPVRLGTYEKADGTRVPLWHDSEVAAIAYAVQNIIARRAAQSALSLAPAEPVQVASSLAPPVMAGKKCSECGAHAVIRKDGCDYCTQCGHLGTCG

SEQ ID NO: 1137 - protein, 512 aa, Polaromonas species JS666
  Posp-JS666 RIR1 C-extein
CGEQPLPPYGCCDLGPIILTRFVRNPFGFNGVPDFDFDAFGKSVTTQVRALDNVLDLTFWPLPQQQAESAAKRRIGVGFTGLGNALVMLCLRYDAPEGREMAARIAVCMRDAAYAASVALAKEKGAFLKFDAEGYLAPGTFANRLPAGLQQAIRAHGIRNSHLLSIAPTGTVSLAFADNASNGIEPSFSWMYRRRKRESDGSTTDYAVEDHAWRLYRELGGDVDRLPGYFVSALEMSAASHIAMMEAVQPFVDTAISKTVNVPVDYAYDDFKGLYQQAWRARLKGLATYRPNAILGAVLETHASAAATPPAAPTPVDPMRTVIESRPKGALSAVAEKVEYWTQEGHKTLYIVVSFLPVPAASGEGTVERAIEFFMPVGQSGESQQWITSSMRMLSLAARGGFLERALSDMRKVAWDRGPVRLGTYEKADGTRVPLWHDSEVAAIAYAVQNIIARRARQPAAGTTPVVEPQVDPALAPPVMAGKKCSECGAHAVIRKDGCDYCTQCGHLGVCG

SEQ ID NO: 1138 - protein, 527 aa, Pseudomonas aeruginosa phage phiEL
  PP-PhiEL Helicase C-extein
TFTSLAWSQLINTAPTVVFCPMNIVDKVWVEQPLQHFKVPPRIWTSISGKVLEEGYDFYIVHYDYMTSGMGKYLENFLIALSKKHKGALKMILDESQNFNDPKAARTRKLIEWCDMELFGHHLPMSGTPLKAQGSEIFPTTCMIDPYFDKKAREFFMASYGRNRPSLMDLLSRRIGRMKFTIPELVGLGDPPPMELVKVKIPNSDQYTLDAIRLQMQIYIGERIAFYTKHMPSFLEFYNDVMTSYELSIQGNAKAVENLVKYKQIVHRFRTRGYNSFTDNQDSQFCKLVEEDIEKGLKGTTLKDFRNIKSAVKYLGLKLRGEALGNVLGRARINAIKDTIAHAGLPELIDNVEKKTLIFTSYVDALKLCEEYLTKVGYPNVTVYGENSNERDTNIKRFEKDPTLRALIAIFDSLKEGYPLIMANLTILLNAPFREYEVKQVQARTWRTGQDAPCYFKLLDMDTGDKLNIMTRSINIMEWSKEQVDILMSKEQGHELLGNITGQEMFDMGDEPETHSLYTSRSVLSLF

SEQ ID NO: 1139 - protein, 594 aa, Pseudomonas aeruginosa phage phiEL
  PP-PhiEL ORF11 C-extein
TVSVQVIDFWLTYIMGRGYTSHLITLKSDNRAQFIAAIKQIRSSIPSYLINSTYKDKDAGTSLTYKAFGEDNVNTLYINVPQISQDAAGDLGRGLRVGTTNYDESGYIRFIDTIIDGCSPSSLTEMALCREQGLPYGITHITTPNTTLHPSGEFMFNKLMSATEWREKFFDCFSESHLRQMLLRASPTKTTSPSVSMVYNYLQLGKDKAWVRETIDLLGLSLAKAKIDLLLMWVEDGENRLFDDVTREAINNMKRDVVWSKEYRDCNLYVDFFVTQQELLEMAKKEYNDHFLIGVDTSSAINKDACTIVIRSMKTGKVIGVGRYPLTFLDDVTAIVVDLLDVIQNSTLIIERNYAHHMIDSLLIMLPAKGMDPFKRVFNQIYQDTVNNAKEFEEVQNTKFAYRNKAFYLKYKQYFGFVTTKTTRDVLYGLIQEAVGNTGYGLCYAKLADELINLKLKGDRIDHDAKQHDDLVIAWLLSYWFIKLGENKSLYGIPPGIALTDTRNLLNSAQNQGRTEYEPYVVQLIDKVRSKVHSLTEELMSTQDNILALRLEVEIRKLAKMLPPEQNRMMTIDVLLENAKVERNKRLLQQRRTA

SEQ ID NO: 1140 - protein, 424 aa, Pseudomonas aeruginosa phage phiEL
  PP-PhiEL ORF39 C-extein
SLTNNGKALKSSEWFHRKVHILSAVVADIDHFMDCGTTTTVPIRIPNMQAAMALLGKFRVTDTGELELIDQTTVWSIKPGEWVNIRSVAFCNHYNSASPCRVCYGMMASSIPYNVMMKKGADVGMWCTTSICNPIGQGMLSTKHFIRNATTRKFVPATKDKNVIYSNGDDIFLTKELCAPGTELVLKADIVNILSDIRSLDVLDNLSLDKLPYFSEVTFRYEVEDIMMGGKTLQQHAACTSVSSRNARFSLEFLNYLLSKGWANEGKKHITVDLSEWNTLSPIFTLPYVREDLDMHRARVENFITFNKRNNAWRQQIVTPRLFGEVLAEYWGLINQETKGINIIHPEVLLYSTLCRDPMRGDYSLANGKGPKYFVNFQECIKGRGAGMLMIYENQQNVLSDPKTFRVVNRQGSPLECFFSLAVS

SEQ ID NO: 1141 - protein, 368 aa, Pseudomonas aeruginosa phage phiEL
  PP-PhiEL ORF40 C-extein
TYMAIHSMVKIGKRTLITMQPRYQINWVRELNKIVKLIPGDLLIWENTLESLYECLEDGKFDPKIIIIPMSRIEVFLRKGKETRDGLHMDDLIKRINPGLRIIDEGHEAIHQIFLSLMFGNIKKLFLLSATLKADDPFTNKMYQYLFPKRLRLKEAEPEHYIDVVAYLYRLNTRRYHLKTEQFGAYNDKTFEKSILKSGVLLAFYFKLVNKAFKEYYLNVRREGTKCLFFFSRVSMCDAMLELFRKEYPGWDFETFTGDDSKLKDKKDKYLKHEIIITTPNSCGTGKDIGGLVTVICAHTVASTQANKQIIGRLRALSGKFNNEIDPAFVFLVCLDLAKHVEYLAKREQVFFEKQKTFKRINSECSLD

SEQ ID NO: 1142 - protein, 57 aa, Porphyra purpurea (chloroplast)
  Ppu DnaB C-extein
SIEQDADLVIMLYRESYYNKEMEMEDMTEIIVAKHRNGPLGTFQLKFDANLANFLNV

SEQ ID NO: 1143 - protein, 283 aa, Pyrococcus species GB-D
  Psp-GBD Pol C-extein
SYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTKQTGLTAWLNIKKK

SEQ ID NO: 1144 - protein, 334 aa, Pichia stipitis CBS 6054, taxon:322104
  Pst VMA C-extein
CGERGNEMAEVLMEFPELFTEINGRKEPIMKRTTLVANTSNMPVAAREASIYTGITLAEYFRDQGKNVSMIADSSSRWAEALREISGRLGEMPADQGFPAYLGAKLASFYERAGKSVALGSPERLGSVSIVAAVSPAGGDFSDPVTTSTLGITQVFWGLDKKLAQRKHFPSINTSVSYSKYTNVLDKYYDANYPEFPALRNKIKEILSDAEELEQVVQLVGKSALSDSDKITLDVASLIKEDFLQQNGYSTYDAFCPIWKTFDMMRAFISYHDEAQKAVANGAQWSKLSESTSDVKHSVSSAKFFEPSRGEAEGKTEFNTLLTSISERFAEASE

SEQ ID NO: 1145 - protein, 140 aa, Pseudomonas syringae pv. tomato str. DC3000
  Psy Fha C-extein
TGPCELPEGYFGAAGGNGPKATATSAAEGATPRVSIDPPDGSFSISDWTGYPAGVPVPQGPFRLLEGTEYNAARNVANKANSALRREQGLVGQPVDVHEINPVKFGGSPTDSANKVILPRDVHRQQVTPWWNQLQKDLGK

SEQ ID NO: 1146 - protein, 353 aa, Picrophilus torridus, DSM 9790
  Pto VMA C-extein
TVIQHQLSKWSDSDIVVYVGCGERGNEMTEILSTFPELMDPKTGKPIMQRTVLIANTSNMPVAAREASIYTGVTIAEYYRDMGYNVALMADSTSRWAEALREISGRLEEMPGEEGYPAYLGRRISEFYERSGNAQIIAEDQRTGSVTLIGAVSPPGGDLSDPVVQNTLRVTRVFWALDASLASRRHFPSINWLTSYSLYTNNLSKWYTENVGPDWPEIYKTMMDLLEKESELQEIVQLVGYDALPEKEKNVLDIAKMIREDFLQQNAFDDIDTYCSIKKQYMMLKIIKTVYEMQMNALNHGMKISQITSIPARSKISRMKEVSEQDFPAFYKNIIKEINDEYNSMIEVGGVNA

SEQ ID NO: 1147 - protein, 57 aa, Porphyra yezoensis chloroplast, cultivar U-51
  Pye DnaB C-extein
SIEQDADLVIMLYRESYYTQETRSRDFTEVIIAKHRNGPTGTFQLKFNAQIAKFSDA

SEQ ID NO: 1148 - protein, 494 aa, Roseovarius species 217
  Rsp Rir1 C-extein
CGEQPLPPYGACLLGSINLARLVTEPFATGARVDAAALDDLVRVAVRMMDNVVDVSGFPLPAQAAEAQAKRRIGLGVTGLADALLMVGLRYGSDEAVQQTEAWLHAIARAAYLASVDLAREKGAFPLFDRDAYLASGTMQAMDEDVRAAVAAHGIRNALLTSIAPTGTISLYAGNVSSGIEPVFAYSYTRKVLQKDGSRTEEEVVDYAVQMWRDRMGDAPLPSYFVNAQTLPPEDHVKMQAAAQKWVDSSISKTINCPEDISFEAFKNVYLQAWDLGCKGCTTYRPNDVTGSVLSVSETSDKVPGETRGDIPVTGGEVVYMSEPLDRPKELEGATYKLKWPDSNHAIYVTVNDIVLNGHRRPFEVFINSKNMEHYAWTVALTRMISAVFRRGGDVSFVVEELKAVFDPRGGAWMQGKYVPSILAAIGGVLEQHLVQIGFLEGEGMGLKQDPQAQIVGIDGARKGPACPACGQYDMRMIEGCMTCGSCGHSKCSG

SEQ ID NO: 1149 - protein, 286 aa, Salmonella phage SETP12
  SaP-SETP12 dpol C-extein
CELGLGYEGGVGAFVTFAKNLGLDLIEMAKTMDGTFPDHIWAATARGYEWARIQEAKRPPHPGEKDDRPSYILDKKVWRTCDAIKRMWRESHPETVAFWRDLKDGILAAVRNPGREFWAGAHLRRNGERAIRIWRTVEFDSSGRKVPGWWLCMELPSGRILSYPGIGVSVTKETDEDGRINTNVRIKYQGENQLTRQWTTLYTHGGKACENIVQALCRDLLAYAMLNVEAGGYPIVLSVHDELVCETPDTPDYTVAELEKLMCALPGWADGFPLVAEGAELKRYAK

SEQ ID NO: 1150 - protein, 286 aa, Salmonella phage SETP3; identical to SEQ ID NO: 1149
  SaP-SETP3 dpol C-extein

SEQ ID NO: 1151 - protein, 440 aa, Salmonella phage SETP3
  SaP-SETP3 Helicase C-extein
SSTLWVLNRLFRNGQLNDDDRVLILAPLRVASGTWPAEQARWNFPCLRVVDATGSEKRRIAALESDANVVCTNYEVIEWLIDYYGKDDWPFTVIVADESTKLKSFRSRSGGSKRAKALSKVAFGKVKRFINLTGTPSPNGLKDLWGQNWFIDAGERLGSSYTAFTDRWFNSVQKGKSAMAREYHARPGADNEIHQKMKDISLTIDAAEWFGCEAPVIVPVEIDLPKKARQAYIDMEEKLFAELESGEVEAANAAAKTSKCLQIASGAVYVSGPDGEATKDWEKVHDTKLDALESIVEELQGAPLLVAYQFKHELERILRRFPQAQAFAKGAKGNKQMESWNRGEIEILCVHPASAGHGLNLQDGGHHLAFISQGWNLEHYLQVVERIGPVRQKQAGHERPVFLYHIVAKDTLDEVVAARTDEKKSVQEELLNYMKRRGKR

SEQ ID NO: 1152 - protein, 286 aa, Salmonella phage SETP5; identical to SEQ ID NO: 1149
  SaP-SETP5 dpol C-extein

SEQ ID NO: 1153 - protein, 427 aa, Streptomyces avermitilis MA-4680
  Sav Helicase C-extein
TMVALRAMLAVVDSGGQAAMLAPTEVLAQQHHRSITEMMGELAEGGMLGGAEHSTKVVLLTGSMGAAARRQALLDLVTGEAGIVIGTHALIEDKVQFHDLGLVVVDEQHRFGVEQRDALRGKGKQPPHLLVMTATPIPRTVAMTVFGDLETSVLDQLPAGRSPIASHVVPAADKPHFLARAWERVREEVGKGHQAYVVCARIGDEEDDPKKAKKKSPEDEAEKRPPLAVLEVADQLAKGPLQGLGVEVLHGRMPPDDKDAVMRRFAAGERDVLVATTVIEVGVNVPNATAMVIMDADRFGVSQLHQLRGRVGRGSAAGLCLLVTEMPEASPARQRLNAVASTLDGFELSRIDLEQRREGDVLGQAQSGVRSSLRMLAVIEDEEIIAEAREEAAAVVAADPELGHLPGLRTALEALLDEEREQYLDKG

SEQ ID NO: 1154 - protein, 73 aa, Saccharomyces castellii, strain CBS4309
  Sca-CBS4309 VMA C-extein
CGERGNEMAEVLMEFPELFTEKDGRKEPIMKRTTLVANTSNMPVAAREASIYTGITLAEYFRDQGKDVSMIAD

SEQ ID NO: 1155 - protein, 73 aa, Saccharomyces cariocanus, strain="UFRJ 50791
  Scar VMA C-extein
CGERGNEMAEVLMEFPELYTEMSGTKEPIMKRTTLVANTSNMPVAAREASIYTGITLAEYFRDQGKNVSMIAD

SEQ ID NO: 1156 - protein, 334 aa, Saccharomyces cerevisiae (nucleus)
  Sce VMA C-extein
CGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLSTMQERFAESTD

SEQ ID NO: 1157 - protein, 34 aa, Saccharomyces cerevisiae strain DH1-1A
  Sce-DH1-1A VMA C-extein
CGERGNEMAEVLMEFPELYTKMSGTKEPIMKRTT

SEQ ID NO: 1158 - protein, 310 aa, Saccharomyces cerevisiae OUT7091
  Sce-OUT7091 VMA C-extein
CGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRG

SEQ ID NO: 1159 - protein, 310 aa, Saccharomyces cerevisiae OUT7112
  Sce-OUT7112 VMA C-extein
CGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNALNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRG

SEQ ID NO: 1160 - protein, 73 aa, Saccharomyces dairenensis, strain CBS 421
  Sda VMA C-extein
CGERGNEMAEVLMEFPELFTEQTGRKEPIMKRTTLVANTSNMPVAAREASIYTGITLAEYFRDQGKDVSMIAD

SEQ ID NO: 1161 - protein, 208 aa, Staphylococcus epidermidis RP62A
  Sep RIR1 C-extein
CTEIFQYMHVSDIKDYYEPDELGQDIICNLASLNMVKSIEEKEIEESIRTGMRALTFVANNSRIEHLPTVHKANKNNRAVGLGVMSFHSMCAKNKIRYGSEESLDLLNVYCMMMDYYSLDESMKIAVERNDKFYGFDQTDYKAKDGKEFGEYFYKNNRVTKNVEPITPKVKEIFKGIYIPTKEDWQRLAREVDKNGLYNSYRLSIAPY

SEQ ID NO: 1162 - protein, 301 aa, Saccharomyces exiguus, strain="IFO1128"
  Sex-IFO1128 VMA C-extein
CGERGNEMAEVLMEFPELFTEINGRKEPIMKRTTLVANTSNMPVAAREASIYTGITLAEYFRDQGKNVSMIADSSSRWAEALREISGRLGEMPADQGFPAYLGAKLASFYERAGKAVALGSPDRIGSVSIVAAVSPAGGDFSDPVTTATLGITQVFWGLDKKLAQRKHFPSINTSVSYSKYTNVLDKFYDQNYPEFPTLRNRMKEILSNAEELEQVVQLVGKSALSDSDKITLDVASLIKEDFLQQNGYSTYDAFCPIWKTFDMMKAFIAYHDEAQKSVANGANWSKLAEATSDVKHQVSS

SEQ ID NO: 1163 - protein, 112 aa, Stigeoclonium helveticum, strain UTEX 441
  She RPB2 (RpoB) C-extein
SRSSGPYSLITQQPLKGRSKHGGQRLGEMEVWAIEAYGAAFTLLELLTIKSDDVTGRLTIWDYVLYKKPLYIGTPASFKVLICELQALCLDIGIYKADKSNILKQINVSSMG

SEQ ID NO: 1164 - protein, 255 aa, Shigella flexneri 5 str. 8401
  ShP-Sfv-5 Primase C-extein
TEVVGHMALEAMRQGVKTCIASLELKPGILLKRLTRQATCCKMPPVLEIDSAFKFYDERLWVFGLTGTAKADRLIEIFDYARRRYGIQLFIIDSLMKCGIGDDDYNGQKAFVDSICDFKNKTNSHVILVTHSRKGDSEEKPTGKMDVKGSGAITGLTDNLFIIWRNKARERALQRVQSGEKMSEKDEQLLASPASVLMLEKQRNGEGWEGGVPLFLDEQSHQFLQLESGSPYSYIANMPKSEYDEAWRQENVTEY

SEQ ID NO: 1165 - protein, 203 aa, Staphylothermus marinus F1
  Smar 1471 C-extein
TGHGGLSTIHAETLDYAIKRLTSPPMNIPPTYMKLMNTFIHLQRVIARIEKGVVRVRRRATIVQEVEDFGKYRTIAVWDPRTDQFKVNLEESLHLRDIAAKRGLELEDIIDEIYRKATVLNWMIYKNIFNVWDVSRIIFNYYYDPVSVYKRAVRELEEAGREAGVPTMVAPEEVASTEELVGGTKEMGEATKELFERTRELEK

SEQ ID NO: 1166 - protein, 268 aa, Staphylothermus marinus F1
  Smar MCM2 C-extein
TVSIAKAGIVARLNARASVLAAGNPKLGRYDHSLPVSKNIDLPPPILSRFDLIFIVEDIPEKTKDTLLAKHILDIHTDYEKAKPLIDTQLLKKYISYARRYIRPKLTQEAKKLLLDFYVNMRLSGVKASKEGPPAIAMTPRQLEALIRLSEAHAKMALKTKATIEDAEEAIRLMYYSLRKVGYDVKSGRLDIDLVELGVSRSKQVKMKEFMKFIDKVFEEYDEIEYKELYNLAKEKGFDKEFVIEMIRRLKKDGLVYEPRPGVLSKVY

SEQ ID NO: 1167 - protein, 323 aa, Saccharomyces pastorianus IFO11023
  Spa VMA C-extein
CGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLS

SEQ ID NO: 1168 - protein, 503 aa, Spirulina platensis, strain C1
  Spl DnaX C-extein
CHMLSTAAFNALLKTLEEPPDRVVFVLATTDPQRVLPTIISRCQRFDFRRIPLQAMATHLETIAAKENIAITPEAVMMVAQIAQGGLRDAESLLDQLSLLSGEITVERVWDLVGAVPERDLMTLLEAIAEGKATAILDQTRELLNRGRDPLIVLQNLGEFYRDLLIAKTAPNRQDLVKLTQPTWESLCAFSQRWEHEIILAGQKHLRDSEVQIKNTTQPRLWLEVTLLGLLPEALRPQTVSTGVVNVQPQPISNQPTSKMRSQPVYKPPAPAQPVSQAVSVPDAPPPPPPPPQPTTANQEEAVNYSLEELWEQILSAIEQLGTQALMRQHGCLRSHHGNVVCIGLKSHPLLKIAQAKISSLEVACQKVFNTKIQVNLEVGMGAVSPGVHPEKTPISQRVQSPPPPPPEPPPPTREPETERPPELTTPKIEDISVKVADNDNNSPVDDVATAAEKLAEFFDGEIIPWYPENTQVTTVSSSSVALEDTIEFYSPEDDDSEDDVPF

SEQ ID NO: 1169 - protein, 276 aa, Salinibacter ruber DSM 13855
  Sru DnaB C-extein
TAFALASAQNAATHPERSTGVAIFSLEMGAQQLAQRMLTSEARVDAHRARTGRMKDDDWQRLARAAGALSDADIYIDDTPGLSVLELRAKCRRLKAEHELGLVVVDYLQLMQASGANLRSGANREQEIAHISRSLKGLAKELDIPVIALSQLNRAVENRGGDKRPQLSDLRESGSIEQDADVVSFIYRAERYGITVDEQGNSTEGIAEIIVGKQRNGPIGSVELAFVDQYARFEPLTTQYDNPGGGPPQGDGSAPMPPDGNAGGGGGNSFEDDAPF

SEQ ID NO: 1170 - protein, 306 aa, Salinibacter ruber DSM 13855
  Sru PolBc C-extein
SFYGLLGFGLSAFNDFEEADRVARTGQQILRQLIDEIRARGGTVIEVDTDGVLFVPPEDVRGEQAEIDYTVSLTEAMPEGIRVGFDGRFKKMLSYKKKNYALLTYDDELKFKGSSLISRSNEPFGRDFVRKAIRRLLDHDVAGLHELYVDTRDKIVNSDWEGVERFARTETLKDTLEQYEADVEAGQRPRAATYELAKEKQNRTGKPVKKGDRITYYITGDDATVTAFKHCRRAEEWDPEDPDENTAYYLKRLDEFASKFEPFFDEADFRLVFSPEDLFGFSADGIEIQREEHASDYAEDQEDVPF

SEQ ID NO: 1171 - protein, 557 aa, Synechocystis species, strain PCC6803
  Ssp DnaX C-extein
CHMLSTAAFNALLKTLEEPPERVVFVLATTDPQRVLPTIISRCQRFDYRRIPLQAMVDHLRYIAGRENINIDQPALTLVAQIANGGLRDAESLLDQLSLLPDLITPDKVWDLVGAVPEQDLLALLEAIASDDAETLLATCRQILNRGREPLVVLQNLASFYLNLLIAQTAPQRSDLVAVTAETWQALCDTAPQWQRGVILQGQQKLKESEIQIRNTTQPRLWLEVTLLGLLPSACGLDTGAVSQTAVRTPVAQPITPPKPSNVVTFPGGSHNHLTVVDSPTMIPVSEPIVLEEKLEADVEPSSFEPSNAHWDLTQLWSETLNNLGALSQSLFKSFGSLINLVGNNATVSVTTQQLLKIAAGKKDELEAALGQACGQSVKVNLVVGKPSTPETTPVNSAPPPSHSKPPAFAPEPSPPPTAAVNANPAPTVPPSPPAIARGPATSEIKPSPRRESNNFSNPSRPKPKPAPAMEEPPPTDIGDSATRKAIEQFAKNFDGEIVASDAAPKQESDNGDDLSTEPTAELGQQPMDHNGHLQINQPTVLNRPAIAPEEEEDLPF

SEQ ID NO: 1172 - protein, 207 aa, Synechocystis species, strain PCC6803
  Ssp GyrB C-extein
SAKQGRDRRFQAILPLRGKILNIEKTDDAKIYKNTEIQALITALGLGIKGDDFDISSLRYHRVVIMTDADVDGAHIRTLLLTFFYRYQRDLVDQGYIYIACPPLYKLERGKNHFYCYSDRELQEQISQFPPNANYTIQRFKGLGEMMPQQLWDTTMNPESRTMKRVHIEDAAEADRIFTVLMGDRVAPRREFIETYGTKLDLTDLDI

SEQ ID NO: 1173 - protein, 62 aa, Synechococcus species JA-2-3B'a(2-13)
  Ssp-JA2 DnaB C-extein
SIEQDADLVMMIYRPEYYDPNTSDRGIAEVIIAKHRNGPTGTVRLLFESQYTQFRNLADPNR

SEQ ID NO: 1174 - protein, 358 aa, Synechococcus species JA-2-3B'a(2-13)
  Ssp-JA2 RIR1 C-extein
CGEIIGHTFHCNLAEIHLNRLDPHNRQEQEEAFTAGALTVAALLHHRFVEPRFQRSREWDPIVGVSFTGLFDFCVKAFGVEWLRWWQEGRPDTPIGKEFKQQEREYLSRWKEIVHRVVWDYCDRHSLRRPNRCTTVQPAGTKSLLTNASPGWHPPKAQRYIRRITFAKNDPVALACLDYGYSVVPAQADKDENGNLLNDPFDPRCTEWLVELPVEVEWANLPGAGQIEIEQFSALAQFDFYMQVQKYYTTHNTSATIELREDEVEALGSRIYEAIRDDEGYISAALLARFDAPFPRLPFEKIDKPTYERLVAEVKKRRRTDNFFAALARYGRNFTLAAEGPAGCDALGCLLPDSAPQS

SEQ ID NO: 1175 - protein, 62 aa, Synechococcus species JA-3-3Ab
  Ssp-JA3 DnaB C-extein
SIEQDADVVMMIYRPEYYDPNTSDRGIAEVIVAKHRNGPTGTVRLLFESQYTQFRNLADPYR

SEQ ID NO: 1176 - protein, 363 aa, Synechococcus species JA-3-3Ab
  Ssp-JA3 RIR1 C-extein
CGEIIGCDFHCNLAEIHLNRLDPHNRQEQEEAFTAGALSAAALLHHRFVEPRFQRSREWDPIVGVSFTGLFDFCVKAFGVDWLRWWQEGRPDTPLGREFKQQEREYLSFWKEVVHRVVWDYCDRHGLRRPNRCTTVQPAGTKSLLTNASPGWHPPKAQRYIRRITFAKNDPVALACLDYGYSVVPAQSDKDENGNLLNDPFDPRCTEWLVELPVEVEWANLPGAEEIEIERFSALAQFDFYMQVQKYYTTHNTSATLELREDEIEALGSRIYEAIRDDEGYISAALLARFDAPFPRLPFEKIDKATYERLMAEVKQRRKVDNFYEALARYDRNLALTAEGPAGCDALGCLMPEASPQGENLSR

SEQ ID NO: 1177 - protein, 437 aa, Staphylococcus phage Twort
  StP-Twort ORF6 C-extein
TECASGIIDQLLPQLEKGETIAFFTGSTEIFHQSADRLKERLNIPIGKIGAGKFDVKQVNVVMIPTLNSNMKDPTEGLKVTPKQNISKKIAKEVLPKFEGGKNQKRFMGMYLKQFEPKTKVDQKVKDELINIYNTSKSDQELLLNLRKHNVIFQNIAKSKNEKKYNKYHQMREFLDSVAVMIVDEAHHSKSDSWYNNLMTCDNALYRIALTGSIDTQDDLLNMRLEALFGEVISRVSNEFLISEGHSAKPTINTIPIMTPKDIENQKEYRDVYDEGITNNEFRNKLIAKLTEKWYNKDKGVLIIVNFITHGENISKLLEELGIEHFFLHGEVDSELRQQKLNDMRSGKLKVMIATSLIDEGVDISGIHALILGAGGKSLRQVLQRIGRALRKKKDDNTTQIFDFEDRTHKFLYEHFKQRLSIYEEEKFEVKDVTRKG

SEQ ID NO: 1178 - protein, 73 aa, Saccharomyces unisporus, strain CBS 398
  Sun VMA C-extein
CGERGNEMAEVLMEFPELFTEINGRKEPIMIRTTLVANTSNMPVAAREASIYTGITLAEYFRDQGKDVSMIAD

SEQ ID NO: 1179 - protein, 355 aa, Thermoplasma acidophilum, ATCC 25905
  Tac-ATCC25905 VMA C-extein
TVIQHQLAKWSDANIVVYIGCGERGNEMTEILTTFPELKDPNTGQPLMTGLSFIANTSNMPVAAREASIYTGITIAEYYRDMGYDVALMADSTSRWAEALREISGRLEEMPGEEGYPAYLGRRVSEFYERSGRARLVSPDERYGSITVIGAVSPPGGDISEPVSQNTLRVTRVFWALDAALANRRHFPSINWLNSYSLYTEDLRSWYDKNVSSEWSALRERAMEILQRESELQEVAQLVGYDAMPEKEKSILDVARIIREDFLQQSAFDEIDAYCSLKKQYLMLKAIMEIDTYQNKALDSGATMDNLASLAVREKLSRMKIVPEAQVESYYNDLVEEIHKEYGNFIGEKNAEASL

SEQ ID NO: 1180 - protein, 355 aa, Thermoplasma acidophilum, DSM1728
  Tac-DSM1728 VMA C-extein
TVIQHQLAKWSDANIVVYIGCGERGNEMTEILTTFPELKDPNTGQPLMDRTVLIANTSNMPVAAREASIYTGITIAEYYRDMGYDVALMADSTSRWAEALREISGRLEEMPGEEGYPAYLGRRVSEFYERSGRARLVSPDERYGSITVIGAVSPPGGDISEPVSQNTLRVTRVFWALDAALANRRHFPSINWLNSYSLYTEDLRSWYDKNVSSEWSALRERAMEILQRESELQEVAQLVGYDAMPEKEKSILDVARIIREDFLQQSAFDEIDAYCSLKKQYLMLKAIMEIDTYQNKALDSGATMDNLASLAVREKLSRMKIVPEAQVESYYNDLVEEIHKEYGNFIGEKNAEASL

SEQ ID NO: 1181 - protein, 1060 aa, Thermococcus aggregans
  Tag Pol-1 (Tsp-TY Pol-1) C-extein
SLYPSIIVTHNVSPDTLEREGCKNYDVAPIVGYKFCKDFPGFIPSILGELITMRQEIKKKMKATIDPIEKKMLDYRQRAVKLLANSILPNEWLPIIENGEVKFVKIGEFIDRYMEEQKDKVRTVDNTEVLEVDNIFAFSLNKESKKSEIKKVKALIRHKYKGEAYEVELNSGRKIHITRGHSLFTIRNGKIKEIWGEEVKVGDLIIVPKKVKLNEKEAVINIPELISKLPDEDTADVVMTTPVKGRKNFFKGMLRTLKWIFGEESKRIRTFNRYLFHLEELGFVKLLPRGYEVTDWEGLKRYRQLYEKLVKNLRYNGNKREYLVRFNDIKDSVSCFPRKELEEWKIGTAKGFRAKCILKVDEDFGKFLGYYVSEGYAGAQKNKTGGMSYSVKLYNENPNVLKDMKNIAEKFFGKVRVGKNCVDIPKKMAYLLAKSLCGVTAENKRIPSIIFDSSEPVRWAFLRAYFVGDGDIHPSKRLRLSTKSELLANQLVFLLNSLGVSSIKIGFDSGVYRVYINEDLPFLQTSRQKNTYYPNLIPKEVLEEIFGRKFQKNITFEKFKELADSGKLDKRKVKLLDFLLNGDIVLDRVKNVEKREYEGYVYDLSVEDNENFLVGFGLLYAHNSYYGYMGYPKARWYSKECAESVTAWGRHYIEMTIKEIEEKFGFKVLYADSVTGDTEIIVKRNGRIEFVPIEKLFERVDYRIGEKEYCILEDVEALTLDNRGKLIWKKVPYVMRHRAKKKVYRIWITNSWYIDVTEDHSLIVAEDGLKEARPMEIEGKSLIATKDDLSGVEYIKPHAIEEISYNGYVYDIEVEGTHRFFANGILVHNTDGFYATIPGEKPETIKKKAKEFLKYINSKLPGLLELEYEGFYLRGFFVAKKRYAVIDEEGRITTRGLEVVRRDWSEIAKETQAKVLEAILKEDSVEKAVEIVKDVVEEIAKYQVPLEKLVIHEQITKDLSEYKAIGPHVAIAKRLAAKGIKVRPGTIISYIVLRGSGKISDRVILLSEYDPKKHKYDPDYYIENQVLPAVLRILEAFGYRKEDLKYQSSKQVGLDAWLKK

SEQ ID NO: 1182 - protein, 437 aa, Thermococcus aggregans
  Tag Pol-2 (Tsp-TY Pol-2) C-extein
SYYGYMGYPKARWYSKECAESVTAWGRHYIEMTIKEIEEKFGFKVLYADSVTGDTEIIVKRNGRIEFVPIEKLFERVDYRIGEKEYCILEDVEALTLDNRGKLIWKKVPYVMRHRAKKKVYRIWITNSWYIDVTEDHSLIVAEDGLKEARPMEIEGKSLIATKDDLSGVEYIKPHAIEEISYNGYVYDIEVEGTHRFFANGILVHNTDGFYATIPGEKPETIKKKAKEFLKYINSKLPGLLELEYEGFYLRGFFVAKKRYAVIDEEGRITTRGLEVVRRDWSEIAKETQAKVLEAILKEDSVEKAVEIVKDVVEEIAKYQVPLEKLVIHEQITKDLSEYKAIGPHVAIAKRLAAKGIKVRPGTIISYIVLRGSGKISDRVILLSEYDPKKHKYDPDYYIENQVLPAVLRILEAFGYRKEDLKYQSSKQVGLDAWLKK

SEQ ID NO: 1183 - protein, 407 aa, Trichodesmium erythraeum IMS101
  Ter DnaB-1 C-extein
TSFAVNIAHSIAANLKLPIAIFSLEMSKEQLVLRLLASEARIESNRLRAGRISQNEWEPLTSAITNLSEMPIFIDDTPNITVNEIRSKTRQLQSEQGGKLGLILLDYLQLMEGNNSDNRVLELARITRNLKGLARELSVPIIALSQLSRSVEARTNKRPMMSDLRESGCLTGESLICLADGKKIPISCLVGNSNFAVLALNENTWKFESAMVSRVFSTGVKPIFSLQTSSGKLIRATANHPFFSMGGWKQLNTLNIGDSLAILNQKMLKCSILYDGHFLSQSDFGPKYGRNLGSIVKSHEWEKSTEIDVEWDEIVEIMPHGEAEVFDLTVPGLHNFVANEIVVHNSIEQDADLVIMLYRDEYYSPDTPDQGIAEVIITKHRNGPTGTVKLLFDPQFTKFRNLAVDKR

SEQ ID NO: 1184 - protein, 600 aa, Trichodesmium erythraeum IMS101
  Ter DnaE-1 C-extein
CYQEQIMKMAQDLAGYSLGEADLLRRCLSGSTKVIDAATGNLFSLKEIAAQPEYWLSRKVFSLDLKSQQVVQQPITEIHPNGVRDVWQITTRTNRKVCATDDHLFYTVLGWKPLKDFSVGDRLGLPNKIPINYRSQISDSKVKFTAYLIGEGYLYTNSFSCSYFCNSDGELIADFYGCAEELFGSSAPIEKQLHLGNKSVIYVRIGLISGLKNWVDSYLQCANSRVQEIPNWIFSLSQSQLQLFLGILWSTSGIFDETIGYTYYSSNSEVLVRQVQHLFLRLGIVSLFNVNKVKGQGELDVSYVVEVRGREDMLKFYKLIKPYLSSYKQGLCESCYLVIKYQQSYQFKYFLTPDFFDLIVKAKKASSMTRALGVCGGEISSVWNFQNTSNRSLSFDKFNNFSTVLADEELTAIANSDVFWDEIISIEYIGKEEVFDLTIPETHNFIANDFIVHNCMGKKKVSEMEKHREKFIDGAAQRGVSSVVAKDLFEQMIKFAEYCLTYETEIMTVEYGPLPIGKIVEYRIECTVYTVDKNGYIYTQPIAQWHNRGMQEVYEYSLEDGTVIRATPEHKFMTEDGQMLPIDEIFERNLDLKCLGTLEL

SEQ ID NO: 1185 - protein, 208 aa, Trichodesmium erythraeum IMS101
  Ter GyrB C-extein
SAKQGRDRRFQAILPLRGKIINIEKTDDAKIYKNNEIQSMITALGLGIKGDEFDASQLRYHKVIIMTDADVDGSHIRTLLLTFFYRYQRALVDQGYIYIACPPLYKVERGRNHYYCYSDRELNELIQNEFPDNANYTIQRFKGLGEMMPVQLWDTTMNPETRTLKRVEIEDAAEADRIFTVLMGDRVAPRREFIETYGPKLKITDLDI

SEQ ID NO: 1186 - protein, 603 aa, Trichodesmium erythraeum IMS101
  Ter Ndse-1 C-extein
CYDEGKRVAETLAFDYHRQNNVDIRVARIFNSLTGDQKVLYYIAKKLYYETFAECYDRINGDISSVSVPCFDENYQTVIKPISAIWKHHVKKKGFKIKITWGKQIKITEDHSLFTRNENNKPQAVFGNEIKVGDEIGIPSYISFLEQPLEPFHITDKILIQEEIYVESEDTISYIEKYGDKMREYLLAKSLSPSQFYSILKTYEAKNQIPWHLWKYLELPLSEKDKVCYLSKKAIKNWIDNVEELLWFLGFYVARGSLIKNEVVLKGEPSQLEKVIELIERIFEYKSEINDSGYISIKSKILVDLIGYGLNFGNQEKDIPNWILQLPEQQLIRFLKGFVAGNNLENQLNFYLEFKTDSQLVAEKLVLILSKFGLVADVSEIEVNEEDIAKIYRIIIEGLEDKNIHNLSKVEQKISALTTGDIAWGKIESIEEFEIDDYVYDFSVPNYENFIGGSYNVFAHNTYGPRMLENDGRVVSNFIVQALKGIPLTVYGDGSQTRSFCYVSDLIEGFIRLMNQDFIGPVNLGNPREYTILELAQKIQTMVNPGTEIIYKPLPQDDPKQRQPDITRGKKYLGWEPTVFLEEGLKLTIEDFRERLKNELPKN

SEQ ID NO: 1187 - protein, 142 aa, Trichodesmium erythraeum IMS101
  Ter Ndse-2 C-extein
TYGPRMLENDGRVVSNFIVQALKGIPLTVYGDGSQTRSFCYVSDLIEGFIRLMNQDFIGPVNLGNPREYTILELAQKIQTMVNPGTEIIYKPLPQDDPKQRQPDITRGKKYLGWEPTVFLEEGLKLTIEDFRERLKNELPKN

SEQ ID NO: 1188 - protein, 452 aa, Trichodesmium erythraeum IMS101
  Ter Snf2 C-extein
TIQTIAFLLKQQEQKALKGPTLLVCPTSVLGNWEREVKKFGPTLKAIVHHGDKRAKGKGFATAVKDTNLVITSYALLHRDEKILETIKWQSVIVDEAQNIKNPEAKQSQAARKLDASFRIALTGTPVENRLSELWSILDFLNPGYLGQKQFFQRRFAIPIEKYGDTSSLQILRSLVQPFILRRLKTDKDIIQDLPEKQENTIFCPLANEQALLYQNIVENSLAEIDTVGGIQRKGKILALLIKLKQLCNHPVLLQIKKGSRKKVEITDKNSGKLQRLGAMLEEIISEEERAIIFTQFAEWGKVLQPYLQKSLGREVSFLYGSTQRSKREEMIDQFQLDPQGPPVMILSLKAGGTGLNLTRANHVFHFDRWWNPAVENQATDRVFRIGQTRNVQVHKFVCTGTLEEKIHDLIESKKELAEQVVGAGEKWLTELDTDQLRNLLILDRNQVIKEE

SEQ ID NO: 1189 - protein, 149 aa, Trichodesmium erythraeum IMS101
  Ter ThyX C-extein
SFDVQSYRFCSGKVIAVADGKTDIETAFYLRPVGEYSDRKGKKYYYSAEQREKDLYWCLEAAKKYKLDMELGMSEEHARGKIPFDYRQHFVVSFNCRSLLHFLDLRFKKNAQLEIQKLCELMWPHFQDWVPNIAEWYEKNRLKKGKLAP

SEQ ID NO: 1190 - protein, 757 aa, Thermococcus fumicolans
  Tfu Pol-1 C-extein
SLYPSIIISHNVSPDTLNREGCGEYDEAPQVGHRFCKDFPGFIPSLLGDLLDERQKVKKHMKATVDPIEKKLLDYRQRAIKILANSFYGYYGYAKARWYCKECAESVTAWGRQYIETTMREIEEKFGFKVLYADSVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVKLWELIGLLVGDGNWGGQSNWAKYYVGLSCGLDKAEIERKVLNPLREASVISNYYDKSKKGDVSILSKWLAGFMVKYFKDENGNKAIPSFMFNLPREYIEAFLRGLFSADGTVSLRRGIPEIRLTSVNRELSDAVRKLLWLVGVSNSLFTETKPNRYLEKESGTHSIHVRIKNKHRFADRIGFLIDRKSTKLSENLGGHTNKKRAYKYDFDLVYPRKIEEITYDGYVYDIEVEGTHRFFANGILVHNTDGFFATIPGADAETVKKKAREFLNYINPKLPGLLELEYEGFYRRGFFVTKKKYAVIDEEGKITTRGLEIVRRDWSEVAKETQARVLEAILRHGDVEEAVRIVKEVTEKLSKYEVPPEKLVIHEQITRELKDYKATGPHVAIAKRLAARGIKVRPGTVISYIVLKGSGRIGDRTIPFDEFDPTKHRYDAEYYIENQVLPAVERILKAFGYKKEDLRYQKTRQVGLGAWLKMGKK

SEQ ID NO: 1191 - protein, 234 aa, Thermococcus fumicolans
  Tfu Pol-2 C-extein
TDGFFATIPGADAETVKKKAREFLNYINPKLPGLLELEYEGFYRRGFFVTKKKYAVIDEEGKITTRGLEIVRRDWSEVAKETQARVLEAILRHGDVEEAVRIVKEVTEKLSKYEVPPEKLVIHEQITRELKDYKATGPHVAIAKRLAARGIKVRPGTVISYIVLKGSGRIGDRTIPFDEFDPTKHRYDAEYYIENQVLPAVERILKAFGYKKEDLRYQKTRQVGLGAWLKMGKK

SEQ ID NO: 1192 - protein, 247 aa, Thermobifida fusca YX
  Tfus Hyp-2914 C-extein
SFGACPHGYVFEGRGLYKSQAAQPGGNATYYSVTLMCGPSDTITDAQINAVRQLREWLMEPAMSIAGTVKGHRDFISTSCPGDTLYRMVRDGVFSKPARWGTTDTEEDEVPHYLNIAQTKEVVVPPKQYVSLRWDTVWTDTAKTAHKDGLAVISKPCDLNGALWLDIEGLAEGEDVQVHMADWERATKKYSLHPIAEGIGTEGRSFPVFPVVNRLGSGRTMDLRVYNVGEQPFTIRRATFKGHVWLR

SEQ ID NO: 1193 - protein, 660 aa, Thermobifida fusca YX
  Tfus RecA-1 C-extein
TTVALHAVANAQRAGGIAAFIDAEHALDPSYAEKIGVNIDDLLLSQPDTGEQALEIVDMLVRSGAISIIVIDSVAALVPRAEIEGEMGDSHVGLQARLMSQALRKIAGALNQTKTTAIFINQLREKVGVMFGCMHYDTLVTLADGTQEKIGTIVDRKLDVEVLSYDPETDRIVPRRVVNWFDNGAADHFLQFTVGRSGKPGGAQFTATPNHLIRTPGGWREAGELIAGDRVLVHEPHYLNEQQRQVVYGSLMGRGTLVPDRHGGPGVHFCMAHTAEQAAYLDWKVSLLGNIAHSRTAEASATVGVEFTPMPELSELHRVVDFGDGHTHLTWEFLKQLTPLALAVWYLDAGTLTIPQSGTDDDARVQIDVETLSPGSRQRLVEYLRDTHELDAAVVQQGADARSLLEFTPAATVRFLELVAPYVPESMSSMLLAQFRGRCSVTPEYSDPVQRLVAAPVLDIQVKPGSTRKFDIEVEGNHNYFVDGVMVHNSPETTSGGRALKFYASVRMDVRRIETLKDGTEAVGNRTRVKVVKNKLAPPFKQAEFDILYGVGISREGGLLDLGVEHGIVRKSGAWYTYEGTQLGQGKENARNFLRANPDMADEIEKRIKQKLGIPTGDDSAPAEEAAKDEAKAASTTKRTTRKTTASTSASKSAAPSTDA

SEQ ID NO: 1194 - protein, 171 aa, Thermobifida fusca YX
  Tfus RecA-2 C-extein
SPETTSGGRALKFYASVRMDVRRIETLKDGTEAVGNRTRVKVVKNKLAPPFKQAEFDILYGVGISREGGLLDLGVEHGIVRKSGAWYTYEGTQLGQGKENARNFLRANPDMADEIEKRIKQKLGIPTGDDSAPAEEAAKDEAKAASTTKRTTRKTTASTSASKSAAPSTDA

SEQ ID NO: 1195 - protein, 73 aa, Torulaspora globosa, strain CBS 764
  Tgl VMA C-extein
CGERGNEMAEVLMEFPELYTEKNGKKEPIMKRTTLVANTSNMPVAAREASIYTGITLAEYFRDQGRDVSMIAD

SEQ ID NO: 1196 - protein, 673 aa, Thermococcus hydrothermalis
  Thy Pol-1 C-extein
SYYGYYGYARARWYCKECAESVTAWGRDYIETTIHEIEERFGFKVLYADSVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYNVGLSLGLDKEEIEEKILKPLKNTGIISNYYDKSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHNTDGFFATIPGADAETVKKKAKEFLKYINAKLPGLLELEYEGFYVRGFFVTKKKYAVIDEEGKITTRGLEIVRRDWSEIAKETQARVLEAILRHGDVEEAVRIVKDVTEKLSKYEVPPEKLVIHEQITRELKDYKATGPHVAIAKRLAARGIKIRPGTVISYIVLKGSGRIGDRAIPFDEFDPTKHRYDAEYYIENQVLPAVERILKAFGYKKEELRYQKTRQVGLGAWLKLKGKK

SEQ ID NO: 1197 - protein, 235 aa, Thermococcus hydrothermalis
  Thy Pol-2 C-extein
TDGFFATIPGADAETVKKKAKEFLKYINAKLPGLLELEYEGFYVRGFFVTKKKYAVIDEEGKITTRGLEIVRRDWSEIAKETQARVLEAILRHGDVEEAVRIVKDVTEKLSKYEVPPEKLVIHEQITRELKDYKATGPHVAIAKRLAARGIKIRPGTVISYIVLKGSGRIGDRAIPFDEFDPTKHRYDAEYYIENQVLPAVERILKAFGYKKEELRYQKTRQVGLGAWLKLKGKK

SEQ ID NO: 1198 - protein, 655 aa, Thermococcus kodakaraensis KOD1
  Tko CDC21-1 C-extein
TAAAVRDEFTGSWVLEAGVLVLADGGFALIDEFDKMSDRDRSAIHEALEQQSYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHNTISISKAGITATLNSRTTVIAAANPKFGRFNRHKSLPEQLDLPPTLLSRFDLIFLLLDEPDEKVDASIAEHILKVRRGEAEAVTPKIPYDLLKKYIAYARKNVHPVLSREAMEEIKRYYVKMRKGLRRGDEDGVQPIPITARQLEALIRLSEAHARMRLSETVTREDARAAIEIIEAMMKTIAVDEEGNLDVSILEVGKSSKKINKIEKLVDIIKSLESEGEFGAPEEKVIEAAKQAGIGTKADIEKLLNELKSDGRVYEPRAGFYRVI

SEQ ID NO: 1199 - protein, 269 aa, Thermococcus kodakaraensis KOD1
  Tko CDC21-2 C-extein
TISISKAGITATLNSRTTVIAAANPKFGRFNRHKSLPEQLDLPPTLLSRFDLIFLLLDEPDEKVDASIAEHILKVRRGEAEAVTPKIPYDLLKKYIAYARKNVHPVLSREAMEEIKRYYVKMRKGLRRGDEDGVQPIPITARQLEALIRLSEAHARMRLSETVTREDARAAIEIIEAMMKTIAVDEEGNLDVSILEVGKSSKKINKIEKLVDIIKSLESEGEFGAPEEKVIEAAKQAGIGTKADIEKLLNELKSDGRVYEPRAGFYRVI

SEQ ID NO: 1200 - protein, 578 aa, Thermococcus kodakaraensis KOD1
  Tko IF2 C-extein
TTLLDRIRHTNVAGKEAGGITQHIGATEVPIDVVKQLAGPLIKLWKGEIKLPGLLFIDTPGHEAFTSLRARGGSLADLAVLVVDINEGFQPQTIESIEILRRYRTPFIVAANKIDRIKGWVIEEDEPFLVNIKKQDQRAIQELETKLWELIGKFYEMGFNANRFDRVQDFTRELAIVPISAKYGIGIPELLVLIAGLSQKYLEEKLKIEVEGPARGTILEVREEVGLGTTIDVIIYDGTLRKDDTIVVGGKDKAIVTKIRALLKPKPLDEIRDPRFRFDQVDEVTAAAGVKIAAPGLEEALAGSPVIAARSEEEIEKAKQEILSQIQSVVINTGKIGVIVKADTLGSLEALSKELQEKGIPIRKADVGNISKTDVMEALSVKEEEPKYGVVLGFNVKVNEDAEEVANAKGVPIFVGNIIYKLIEDYEAWVKEEEEKRKRELLKNVTFPGVIRLYPDERYVFRRSKPAIVGVEVLEGRIRPGVTLIKETGEKVGVIKSIKNKNDFVQEAKKGDAVAIAIEGAIVGRHIHPGETLYVDLSKNDVIILAKQLKDELEETDIKALKMTAKVKAKEDPFWRAV

SEQ ID NO: 1201 - protein, 164 aa, Thermococcus kodakaraensis KOD1
  Tko KlbA C-extein
CMGTIHANSARETIVRLESPPMSVPRIMIPALDIILMQVRFHSRKKGTIRRVTEIAEVSGLEGESIQLNTLYKYDPAKDELVPTGVPSRTVNILAQHTGMSVREIELEIEKRRLILEWMVEKGIRDIDKVGYYIRQFYIDEEWLLNKISAESDVETSKQIQALM

SEQ ID NO: 1202 - protein, 520 aa, Thermococcus kodakaraensis KOD1
  Tko LHR C-extein
SSTSLELGIDIGTIDLVVLIGSPKSVNRALQRIGRAGHRLHDVSKGVILALDRDDLVEVTVLAHNARNRRLDRVRIPKNPLDVLVQHIVGMALYKVWEVEEAYRLVRRAYPFHELPFEDFMSVLKYLSGGYEGLEDRKVYAKIWLEDGKFGRRGKMTRAIYYMNVGTIPDEAKIRVYTMDKQMIGTVEEEFAERLMPGDIFVLAGRTYEFIKSRGNKIYVVPREGAKPTIPAWFSEMLPLSFDLALDVQRFRREVKELLNKKRAKSLLMRKYGIDERAAKAIIAYFREQERYSTVPDDETVLVEEVEKENTYEYFFHTLIGRRANDALSRAFAYAVGRRKGVNVGIALNDNGFLLRVPKEARLSEAEIRELFQLEDLREILKRALDNTELLKRRFRHVANRGFLILRRYVGGSKRLGRQQVIAVSLLKVLKEHYPDFPLLKEVYREIMEDKMDVENAELFLSWVREGKIKVVFERNELPSPFAFNLEAIGSSDVVLMEDRREMIKALYRKIMALIGENAT

SEQ ID NO: 1203 - protein, 904 aa, Pyrococcus/ Thermococcus kodakaraensis KOD1
  Tko Pol-1 (Pko Pol-1) C-extein
SLYPSIIITHNVSPDTLNREGCKEYDVAPQVGHRFCKDFPGFIPSLLGDLLEERQKIKKKMKATIDPIERKLLDYRQRAIKILANSILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYSSAMATSTEQETQALNEKRALANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHNSYYGYYGYARARWYCKECAESVTAWGREYITMTIKEIEEKYGFKVIYSDTDGFFATIPGADAETVKKKAMEFLNYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTRQVGLSAWLKPKGT

SEQ ID NO: 1204 - protein, 283 aa, Pyrococcus/Thermococcus kodakaraensis KOD1
  Tko Pol-2 (Pko Pol-2) C-extein
SYYGYYGYARARWYCKECAESVTAWGREYITMTIKEIEEKYGFKVIYSDTDGFFATIPGADAETVKKKAMEFLNYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTRQVGLSAWLKPKGT

SEQ ID NO: 1205 - protein, 361 aa, Thermococcus kodakaraensis KOD1
  Tko Pol-II C-extein
CDGDEDAVMLLLDALLNFSKYYLPEKRGGKMDAPLVVTTRLDPREVDSEVHNMDVVRYYPLEFYKATYELKSPKEVKVIERVEDRLGKPEMYEGIKFTHDTDDIGLGPKMSLYKQLGDMEEKVARQLALAERIRAVDEHHVAETIINSHLVPDLRGNLRSFTRQEFRCVKCNTKYRRPPLTGKCPKCGGKIVLTVSKGAIEKYLPTAKMLVTKYRVKDYTRQRICITEKDIKTLFENVFPEKQRTLMGFSADICEKMVKERTGHSNGKNGYLDEFNGKNGKASKKSGSLASKLSGKGKEPSKKKESAKPKRSEKVKNLTSFEAAAKNEQARGTAGNAKKAESEKPKRKKRKGISLDEFFGS

SEQ ID NO: 1206 - protein, 262 aa, Thermococcus kodakaraensis KOD1
  Tko r-Gyr C-extein
CTYHRTDSTHVSNTGIEVAKEYITQELGEKYFKPRPWGEEGAHEAIRPTRPIDTGRLMQLIRDGIIQLPRNLTRNHYRLYDMIFRRFMTSQMTPAKILYEKAVINAGVGKAELEGYVEIIEDGWTRLRSPPLRELPKLEKGMKLKVVEAKKWKAPKVSLYTQGDIIALMKERKIGRPSTYAKIVETLMRRGYVVETKGRKKLLPTEKGIKVYHYLVSKYRDLVSEERTRELEEIMDRIEEGIEDYIKVLGELYSEIQRYVSG

SEQ ID NO: 1207 - protein, 205 aa, Thermococcus kodakaraensis KOD1
  Tko RadA C-extein
TQLAHTLAVMVQKPPEEGGLGGSVIWIDTENTFRPERIKQIAENRGLDPEETLKNIYVARAFNSNHQMLLVEKAEEIIKEKAESDRPVKLLVVDSLMAHFRAEYVGRGTLAERQQKLAKHLADLHRLADLYDIAVFVTNQVQAKPDAFFGDPTRPVGGHILAHSATLRVYLRKGKAGKRVARLIDSPHLPEGEAVFRITEKGVED

SEQ ID NO: 1208 - protein, 991 aa, Thermococcus kodakaraensis KOD1
  Tko RIR1-1 C-extein
TGLNFSKLRPEGDLVGTTTGAASGPVSFMHLIDAVSDVIKQGGVRRGANMGILEVWHPDIEKFIHAKEKNTGTNVLSNFNISVGLWEDFWEALKEGKRYPLINPRTGEKVKEIDPKSLFEELAYMAWAKADPGVVFFDVINRRNVLEPAKGEKIRATNPCVVGDTRVLTPEGYIKAEELFSLAKERGKKEAVAVEGIAEEGEPYAYSVEVLLPGEEEVKYETVHGKALAIADPVAVPAYVWKVGKKKVARVRTKQGYEITATLDHRLMTSEGWKEVGELKPGDEILLPRFEIEEDFGSESIGEDLAFVLGWFIGDGYLNVNDKRAWFYFNAEKEEDIAWKIREILAKHFGIKAEPHRYGNQIKLGVRGEAYRWLESIMGSNEKRVPEIIYRLKPREIAAFLRGLFSADGYVDNDNAVRLTSKDRGLLRDVQDLLLLFGILSKIYERPYSSEFKYTTKDGEERTYRAEGYYELVIANYSRKLFAEKIGFEGYKMEKLSLQKTKIDEPVVTVESVEVLGEEIVYDFTVPEHHSYISNGFMSHNCGEEPLYEYESCNLASINLAKFVKYDDEGKPYFDWDEYAYVIQKVAKYLDNAIDVNKFPLPEIDRNTKLTRRIGVGMMGLADALFKLGIPYNSKEGFDFMRKATEYLTFYAYKRSVEAAKERGPFPLYEKTRYKDGELPVEGFYHREIWNLPWDELVEEIKKYGVRNGMVTTCPPTGSVSMIADTSSGIEPIFALVYKKSVTVGEFYYVDPVFEAELKKRGLWSDEILKKISDNYGSVQGLEEIPEDMQRVFVTAMDIHWLDHILAQANIQLWLTDSASKTINMPNDATVEDVKAAYLLAYKLGCKGVTVYRDGSLSVQVYSVEGEKKKRVPAKPSDYAVEKLKTIVEAEPWLSRFINVEAILNGTNGKEKSAQAGGLTFSVSHVSAVKPAHEHSHHAKRPDIPEEKIRELLGVAYCPVCYEKDGELVELRMESGCATCPRCGWSKCVIS

SEQ ID NO: 1209 - protein, 450 aa, Thermococcus kodakaraensis KOD1
  Tko RIR1-2 C-extein
CGEEPLYEYESCNLASINLAKFVKYDDEGKPYFDWDEYAYVIQKVAKYLDNAIDVNKFPLPEIDRNTKLTRRIGVGMMGLADALFKLGIPYNSKEGFDFMRKATEYLTFYAYKRSVEAAKERGPFPLYEKTRYKDGELPVEGFYHREIWNLPWDELVEEIKKYGVRNGMVTTCPPTGSVSMIADTSSGIEPIFALVYKKSVTVGEFYYVDPVFEAELKKRGLWSDEILKKISDNYGSVQGLEEIPEDMQRVFVTAMDIHWLDHILAQANIQLWLTDSASKTINMPNDATVEDVKAAYLLAYKLGCKGVTVYRDGSLSVQVYSVEGEKKKRVPAKPSDYAVEKLKTIVEAEPWLSRFINVEAILNGTNGKEKSAQAGGLTFSVSHVSAVKPAHEHSHHAKRPDIPEEKIRELLGVAYCPVCYEKDGELVELRMESGCATCPRCGWSKCVIS

SEQ ID NO: 1210 - protein, 403 aa, Thermococcus kodakaraensis KOD1
  Tko TopA C-extein
CSYPRTSSQKLPKNLNFRSIIQNLAKLPEYKPFAHELLGKESLKPVEGKKDDPAHPAIYPTGELPKPGELTKDEGNLYDLIVRRFLALFMEPAVRETMKVVINSNNHRFILSGARTLKEGWLKVYGKYVKFDEVILPAFKEGEPVKVIQIKREKKKTKPPARYSPAAVIKKMEDLGIGTKATRAQILETLYQRGYIEGKKKIKVTPLGMRVVEALEKNVPDIVSVELTRAFEEKMEEIMAGKADKDQVIEESKEQLIKILQVFKEKELDIGKMLLESTGTGVTTSKEAAKKTGAVKDANDEEKSDGKAGEGTTPKAERKPLVVGKCPKCGGDLVIRYNRKTGKRFVGCSNWPKCDVTYPILQRGQVIPTEKTCCNGAPVVKIREKGREYEICLDMNCKDWKKK

SEQ ID NO: 1211 - protein, 670 aa, Thermococcus litoralis
  Tli Pol-1 C-extein
SYYGYMGYPKARWYSKECAESVTAWGRHYIEMTIREIEEKFGFKVLYADSVSGESEIIIRQNGKIRFVKIKDLFSKVDYSIGEKEYCILEGVEALTLDDDGKLVWKPVPYVMRHRANKRMFRIWLTNSWYIDVTEDHSLIGYLNTSKTKTAKKIGERLKEVKPFELGKAVKSLICPNAPLKDENTKTSEIAVKFWELVGLIVGDGNWGGDSRWAEYYLGLSTGKDAEEIKQKLLEPLKTYGVISNYYPKNEKGDFNILAKSLVKFMKRHFKDEKGRRKIPEFMYELPVTYIEAFLRGLFSADGTVTIRKGVPEIRLTNIDADFLREVRKLLWIVGISNSIFAETTPNRYNGVSTGTYSKHLRIKNKWRFAERIGFLIERKQKRLLEHLKSARVKRNTIDFGFDLVHVKKVEEIPYEGYVYDIEVEETHRFFANNILVHNTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSKQTGLDAWLKR

SEQ ID NO: 1212 - protein, 231 aa, Thermococcus litoralis
  Tli Pol-2 C-extein
TDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSKQTGLDAWLKR

SEQ ID NO: 1213 - protein, 73 aa, Torulaspora pretoriensis, strain CBS 5080
  Tpr VMA C-extein
CGERGNEMAEVLMEFPELHTEKNGKMEPIMKRTTLVANTSNMPVAAREASIYTGITLAEYFRDQGRDVAMIAD

SEQ ID NO: 1214 - protein, 673 aa, Thermococcus species GE8
  Tsp-GE8 Pol-1 C-extein
SYYGYYGYAKARWYCRECAESVTAWGRSYIETTIREIEEKFGFKVLYADSVAGNTEVIIRRNGKVEFVPIEKLFQRVDYRIGEKEYCALEGVEALTLDNRGRLVWRKVPYIMRHKTNKKIYRVWFTNSWYLDVTEDHSLIGYLNTSKVKSEKPLKERLVEVKPRELGEKVKSLITLNRAIARSIKANPIAVRLWELIGLLVGDGNWGGHSKWAKYYVGLSCGLDKAEIEEKVLRPLKEAGIISNYYGKSKKGDVSILSKWLAGFMVKYFKDENGNKRIPSFMFNLPREYIEAFLRGLFSADGTVSLRRGIPEIRLTSVNRELSNEVRKLLWLVGVSNSMFTETTPNKYLGNESGTRSIHVRIKNKHRFAKRIGFLLDRKATKLSDNLREHTNKKMAYRYDFDLVYPKKIEEINYDRYVYDIEVEGTHRFFANGILVHNTDGFFATIPGADAETVKKKAMEFLKYINAKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTKQVGLGAWLKVKGKK

SEQ ID NO: 1215 - protein, 235 aa, Thermococcus species GE8
  Tsp-GE8 Pol-2 C-extein
TDGFFATIPGADAETVKKKAMEFLKYINAKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTKQVGLGAWLKVKGKK

SEQ ID NO: 1216 - protein, 673 aa, Thermococcus species GT
  Tsp-GT Pol-1 C-extein
SYYGYYGYARARWYCKECAESVTAWGRDYIETTIHEIEERFGFKVLYADSVTGETEIIIKRNGKVEFVAIEELFQRVDYRIGEKEYCVLEGVEALTLDNRGRLVWKSVPYVMRHRTNKRIYRVWFTNSWYLDVTEDHSLIGYMNTSKVKPGKPLKERLVEVKPGELGESVKSLITPNRAIAHGIRVNPIAVKLWELIGLLVGDGNWGGQSNWAKYYVGLSLGLDKEEIEEKILKPLKNTGIISNYYDRSKKGDVSILSKWLARFMVRYFKDESGSKRIPEFMFNLPREYIEAFLRGLFSADGTVSLRKGVPEVRLTSVNPELSSSVRKLLWLVGVSNSMFVETNPNRYLGKESGTHSVHVRIKDKHRFAERIGFLLDRKATKLSENLGGHTSKKRAYKYDFDLVYPKKVEEIAYDGYVYDIEVEGTHRFFANGILVHNTDGFFATIPGADAETVKKKAKEFLKYINAKLPGLLELEYEGFYVRGFFVTKKKYAVIDEEGKITTRGLEIVRRDWSEIAKETQARVLEAILRHGDVEEAVRIVKDVTEKLSKYEVPPEKLVIHEQITRELKDYKATGPHVAIAKRLAARGIKIRPGTVISYIVLKGSGRIGDRAIPFDEFDPTKHRYDAEYYIENQVLPAVERILKAFGYKNEDLRYQKTRQVGLGAWLKPKGKK

SEQ ID NO: 1217 - protein, 1307 aa, Thermococcus species GT
  Tsp-GT Pol-2 C-extein
TDGFFATIPGADAETVKKKAKEFLKYINAKLPGLLELEYEGFYVRGFFVTKKKYAVIDEEGKITTRGLEIVRRDWSEIAKETQARVLEAILRHGDVEEAVRIVKDVTEKLSKYEVPPEKLVIHEQITRELKDYKATGPHVAIAKRLAARGIKIRPGTVISYIVLKGSGRIGDRAIPFDEFDPTKHRYDAEYYIENQVLPAVERILKAFGYKNEDLRYQKTRQVGLGAWLKPKGKKMILDVDYITEDGKPVIRIFKKEKGEFKIEYDRDFEPYIYALLKDDSAIEEVKKITAERHGKVVKVKRAEKVNKKFLGRPVEVWKLYFEHPQDVPAIRDKIRAHPGVIDIYEYDIPFAKRYLIDKGLVPMEGDEELKMLAFDIETLYHEGEEFGTGPILMISYADENEARVITWKKIDLPYVDVVSTEKEMIKRFLRVVKEKDPDVLITYNGDNFDFAYLKKRCEKLGISFTLGRDGSEPKIHRMGDRFAVEVKGRIHFDLYPVIRRTINLPTYTLEVVYEAVFGKPKEKVYAEEITLAWESGEGLERVARYSMEDAKATYELGREFFPMEAQLSRLIGQSLWDVSRSSTGNLVEWFLLRKAYERNELAPNKPDEGELARRRNSYAGGYVKEPERGLWDNIVYLDFRSLYPSIIITHNVSPDTLNREGCKEYDVAPQVGHKFCKDFPGFIPSLLGNLLEERQKIKRKMKATIDPLEKKLLDYRQRAIKILANSILPDEWVPLLIDGRLKLTRIGDFVDNAMDEGNPLKSNETEVLEVLGINAISFNRKTKISEVRPVRALIRHRYRGKVYSIKLSSGRKIKVTEGHSLFTVKNGELVEVTGGKVKPGDFIAVPRRINLPERHERINLADVLLNLPEEETADVVLTIPTKGRKNFFRGMLRTLRWIFEGEKRPRTARRYLEHLQKLGYVRLKKIGYEVLDEKALRKYRALYEVLAEKVRYNGNKREYLVAFNDLRDKIEFMPEEELREWKIGTLNGFRMEPFIEVNEDLAKLLGYYVSEGYAGKQRNQKNGWSYSVKLYNNDQKVLDDMERLASKFFGKVRRGKNYVEMPKKMAYVLFKSLCGTLAENKRVPEVIFTSPENVRWAFLEGYFIGDGDLHPSKRVRLSTKSETLVNGLIILLNSLGISAVKIRFESGVYRVLVNEELSFLGNSKKKNAYYSHVIPKEILEDVFEKRFQKNVSPKKLREKIKRGELNQEKAKRISWLLEGDIVLDRVEEVEVEDYNGYVYDLSVEENENFLAGFGMIYAHNSYYGYYGYPRARWYCKECAESVTAWGREYIEMTIREIEEKYGFKVL

SEQ ID NO: 1218 - protein, 877 aa, Thermus thermophilus HB27
  Tth-HB27 DnaE-1 C-extein
SMGKKKVEEMKSHRERFVQGAKERGVPEEEANRLFDMLEAFANYGFNKCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTGDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNSHAAAYSLLSYQTAYVKAHYPVEFMAALLSVERHDSDKVAEYIRDARAMGIEVLPPDVNRSGFDFLVQGRQILFGLSAVKNVGEAAAEAILRERERGGPYRSLGDFLKRLDEKVLNKRTLEFLIKAGALDGFGERARLLASLEGLLKWAAENREKARSGMMGLFSEVEEPPLAEAAPLDEITRLRYEKEALGIYVSGHPILRYPGLRETATCTLEELPHLARDLPPRSRVLLAGMVEEVVRKPTKSGGMMARFVLSDETGALEAVAFGRAYDQVSPRLKEDTPVLVLAEVEREEGGVRVLAQAVWTYEELEQVPRALEVEVEASLLDDRGVAHLKSLLDEHAGTLPLYVRVQGAFGEALLALREVRVGEEALGALEAAGFRAYLLPDREVLLQGGQAGEAQEAVPF

SEQ ID NO: 1219 - protein, 406 aa, Thermus thermophilus HB27
  Tth-HB27 DnaE-2 C-extein
SHAAAYSLLSYQTAYVKAHYPVEFMAALLSVERHDSDKVAEYIRDARAMGIEVLPPDVNRSGFDFLVQGRQILFGLSAVKNVGEAAAEAILRERERGGPYRSLGDFLKRLDEKVLNKRTLEFLIKAGALDGFGERARLLASLEGLLKWAAENREKARSGMMGLFSEVEEPPLAEAAPLDEITRLRYEKEALGIYVSGHPILRYPGLRETATCTLEELPHLARDLPPRSRVLLAGMVEEVVRKPTKSGGMMARFVLSDETGALEAVAFGRAYDQVSPRLKEDTPVLVLAEVEREEGGVRVLAQAVWTYEELEQVPRALEVEVEASLLDDRGVAHLKSLLDEHAGTLPLYVRVQGAFGEALLALREVRVGEEALGALEAAGFRAYLLPDREVLLQGGQAGEAQEAVPF

SEQ ID NO: 1220 - protein, 1064 aa, Thermus thermophilus HB27
  Tth-HB27 RIR1-1 C-extein
TRRGAGMATLSIEHPDLLDFLTAKDLDREKAEGDISTFNISVLATDRFLEAVEKDELWPVTPIEVPGKYYPYPVEGPYTGKLPSLPEREDGAKAIPLYGGKVPARWLWHEIAWHAWATGEPGLIFVDRVNALSALKGLGERYQIRSTNPCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGPGTLQETRSNTFHLHFNRIPAEFFQALGVKAARATEKRVPESLFRAPREAVVGFLQGLFSADGSVQINENKQDATVRLASSSLALLQDVQLLLLNLGILGKIHKRREAARKALPDGKGGLREYPVAPQYELILGGENRDRFAEVVGFLQEEKQSKLLAFLRHRPRGSYRKPFLATVASVEPAGEAPVYDLTEPVTHSLIANGLVAHNCGEIPLTVGEPCDLGAMNLAAYVKDGEFQMEEFRRDVRTAIRFLDNVLDVNKFALPDNEMAAKSLRRLGLGLMGLADALIKMGLPYDSEEARRKVYEIVSVMREEAIRASEALAEERGPFPLYEEHREYFQSLGIRPRRNVALLTVAPTGTTSMLMGVSSGIEPVFSPFVWRRIGGEYKPLLHPLFVELMEAYPPAPGYAKDGKWDWEKIIEEIQKDGHGSVQNLPFVPEAIRKVFLCAHDVHPLDHVRMQGAVQRAFDAEGYAANSISKTINLPNHAAVEDVEAAYTEAYRTGCKGITVYRDGSREFQVLTVKKEAKEEKAGKTPEEAKPQEARAHEPGRPVYERPGRLMGFTDMVKLFAPDGSKRSFLVTVNTLEGRPIEVILTSGKAGDEANADSEALGRVVSIALQYGVPPEAIVRTLRGINGGLYGTYQGRLVSSKADLIAVALETVPQMAPGAPEDLSSAPVLSGGGIALAGAAPCPSCGEKALVREEGCWKCQACGYAKCG

SEQ ID NO: 1221 - protein, 508 aa, Thermus thermophilus HB27
  Tth-HB27 RIR1-2 C-extein
CGEIPLTVGEPCDLGAMNLAAYVKDGEFQMEEFRRDVRTAIRFLDNVLDVNKFALPDNEMAAKSLRRLGLGLMGLADALIKMGLPYDSEEARRKVYEIVSVMREEAIRASEALAEERGPFPLYEEHREYFQSLGIRPRRNVALLTVAPTGTTSMLMGVSSGIEPVFSPFVWRRIGGEYKPLLHPLFVELMEAYPPAPGYAKDGKWDWEKIIEEIQKDGHGSVQNLPFVPEAIRKVFLCAHDVHPLDHVRMQGAVQRAFDAEGYAANSISKTINLPNHAAVEDVEAAYTEAYRTGCKGITVYRDGSREFQVLTVKKEAKEEKAGKTPEEAKPQEARAHEPGRPVYERPGRLMGFTDMVKLFAPDGSKRSFLVTVNTLEGRPIEVILTSGKAGDEANADSEALGRVVSIALQYGVPPEAIVRTLRGINGGLYGTYQGRLVSSKADLIAVALETVPQMAPGAPEDLSSAPVLSGGGIALAGAAPCPSCGEKALVREEGCWKCQACGYAKCG

SEQ ID NO: 1222 - protein, 877 aa, Thermus thermophilus HB8
  Tth-HB8 DnaE-1 C-extein
SMGKKKVEEMKSHRERFVQGAKERGVPEEEANRLFDMLEAFANYGFNKCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTRDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNSHAAAYSLLSYQTAYVKAHYPVEFMAALLSVERHDSDKVAEYIRDARAMGIEVLPPDVNRSGFDFLVQGRQILFGLSAVKNVGEAAAEAILRERERGGPYRSLGDFLKRLDEKVLNKRTLESLIKAGALDGFGERARLLASLEGLLKWAAENREKARSGMMGLFSEVEEPPLAEAAPLDEITRLRYEKEALGIYVSGHPILRYPGLRETATCTLEELPHLARDLPPRSRVLLAGMVEEVVRKPTKSGGMMARFVLSDETGALEAVAFGRAYDQVSPRLKEDTPVLVLAEVEREEGGVRVLAQAVWTYEELEQVPRALEVEVEASLLDDRGVAHLKSLLDEHAGTLPLYVRVQGAFGEALLALREVRVGEEALGALEAAGFRAYLLPDREVLLQGGQAGEAQEAVPF

SEQ ID NO: 1223 - protein, 406 aa, Thermus thermophilus HB8
  Tth-HB8 DnaE-2 C-extein
SHAAAYSLLSYQTAYVKAHYPVEFMAALLSVERHDSDKVAEYIRDARAMGIEVLPPDVNRSGFDFLVQGRQILFGLSAVKNVGEAAAEAILRERERGGPYRSLGDFLKRLDEKVLNKRTLESLIKAGALDGFGERARLLASLEGLLKWAAENREKARSGMMGLFSEVEEPPLAEAAPLDEITRLRYEKEALGIYVSGHPILRYPGLRETATCTLEELPHLARDLPPRSRVLLAGMVEEVVRKPTKSGGMMARFVLSDETGALEAVAFGRAYDQVSPRLKEDTPVLVLAEVEREEGGVRVLAQAVWTYEELEQVPRALEVEVEASLLDDRGVAHLKSLLDEHAGTLPLYVRVQGAFGEALLALREVRVGEEALGALEAAGFRAYLLPDREVLLQGGQAGEAQEAVPF

SEQ ID NO: 1224 - protein, 908 aa, Thermus thermophilus HB8
  Tth-HB8 RIR1-2 C-extein
CGEIPLTVGEPCDLGAMNLAAYVKDGEFQMEEFRRDVRTAIRFLDNVLDVNKFALPDNEMAAKKLRRLGLGLMGLADALIKMGLPYDSEEARRKVYEIVSAMREEAIRASEALAEERGPFPLYEEHREYFQSLGIKPRRNVALLTVAPTGTTSMLMGVSSGIEPVFSPFVWRRIGGEYKPLLHPLFVELMEAYPPAPGFAKEGKWDWEKIVEEIQKDGHGSVQNLPFVPEAIRRVFLSAHDIHPLDHVRMQGAVQRAFDAEGYAANSISKCIAKGTLIPTSKGLIPIEEIAPPHPEDTFVPVEGLYTAEGYRITAHYYAGKKRGVRIRLDNGAELVGAWESHRLLTPEGWRLMRELKPGDVVLGKLVPSHGEGGLPIPEAKGLSLRTNARNLPLPERMSEDLALFLGMLAADGSTVEATGFVGIATKDPDVERVFQEVAGRLFGVEPKCTVDKRTGVRNLYLTSRRLVRFVEALIGKGAAQKRVPSQILQGSPGEKLAFLRGLTLDGYVHANMGLVVYEGRSQRLAYEAAELARSFGLPKVYQGRKKVLAPKETYYVHSVAVSGPLQELLEPLEAHKRAKVEARYKVFVPQEVLAATRVGTHHPGYVSLKSVRQREAQAVYNTTAERLGWPTEILAHRVVEVEEVGEVEMYDIEVEEVHRYVVNGLISHNTINLPNHATVEDVEAAYTEAYRTGCKGITVYRDGSREFQVLTVKKEAKEEKAGKTPEEAKPQEARAHEPGRPVYERPGRLMGFTDMVKLFAPDGSKRSFLVTVNTLEGRPIEVILTSGKAGDEANADSEALGRVVSIALQYGVPPEAIVRTLRGINGGLYGTYQGRLVSSKADLIAVALETVPQMAPGAPEDLSSAPVLSGGGIALAGAAPCPSCGEKALVREEGCWKCQACGYAKCG

SEQ ID NO: 1225 - protein, 444 aa, Thermococcus zilligii
  Tzi Pol C-extein
SYYGYYGYANARWYCRECAESVTAWGRQYIETTMREIEEKFGFKVLYADSVTGDTEVIIRRNGRIEFVPIERLFEHVDYRVGEKEYCVLSGVEALTLDNRGRLVWKKVPYVMRHKTDKRIYRVWVTNSRYLNVTEDHSLIGYLDGKYLEIRPADIPKDPDIKLITLASPGLQEVALKTPSRLEEITYEGYVYDIEVEGTHRFFANGILVHNTDGFFATIPGADAETVKKKAKEFLNYINPRLPGLLELEYEGFYRRGFFVTKKKYAVIDEEDKITTRGLEIVRRDWSEIAKETQARVLEAILKHGDVEEAVRIVKEVTEKLSRYEVPPEKLVIYEQITRDLRDYRATGPHVAVAKRLAARGIKIRPGTVISYIVLKGPGRVGDRAIPFDEFDPAKHRYDAEYYIENQVLPAVERILRAFGYRKEDLRYQKTKQAGLGAWLKPKT

SEQ ID NO: 1226 - protein, 199 aa, uncultured archaeon GZfos13E1
  Unc-ERS PFL C-extein
CHNPELVDPKQFSNLISEKKIFSFLEERRGKLDAVEITGGEPTLQPDLIDFMCDLKKLDYLVKLDSNGSKPEILSEAIEHEIVDYIAMDVKAPLERYQEITNSRVDPVKIEHSIELIMSSGLDYEFRTTVVKSQLGKRDILEIGRLIRGSKRYILQKFVPVKVLDKKFLDEVFFYTDDELESLRNAVKRKGYVAECKVR

SEQ ID NO: 1227 - protein, 318 aa, uncultured archaeon GZfos9C4
  Unc-ERS RIR1 C-extein
CGEQPLLPYDSCNLGSINVSKFVKSGDGEIDWERLREVICISVKFLDDVIDVNRYPLPEIEKMTKANRKIGLGIMGFAELLIKLGIAYDSKDALSTGEKLMQFITNEARRCSTELGLERGSFSNFELSVWNSKYEAMRNATVTTIAPTGTISIIAGCSSGIEPIFAVAFVRNVMGGMLEINKLFEEIAKERGFYSKELITEIAKCGSVQDIDGVPGDIKRVFVTALDISPEWHVRMQAAFQKYTDNATSKTVNLPSDATWGDVKKVFLLAYKLKCKGITIYRYGSKEQVLSLDIPKLMLEEYVCADSEYTGECRICSV

SEQ ID NO: 1228 - protein, 287 aa, uncultured archaeon (Rice Cluster I)
  Unc-MetRFS MCM2 C-extein
SISIAKAGILATLKCRCAILGAANPKLGRFDPYESIPDQINMPPSLMSRFDLIFILQDKPEEKRDTNIAGHILKSHFAGELHEHRKNNPASHVTDDMVRTAMSTIKPQIDPKLFRKYVAYAKRKVFPIMTEDAKAQIINFYLGLRKQGEGDNAPIPVTARQLEGLVRLAEASARMRLSDKVTADDVARTIRITMTSLKQVGMDTETGRLDIDVLQVGVAKSQRDRIKNLKHLIEDLSREYEGSVPVDVLIDRAVESGMPKDKVEKELKKLREIGEIFEPKSGHLSLS

SEQ ID NO: 1229 - protein, 68 aa, Vanderwaltozyma polyspora, formerly Kluyveromyces polysporus, strain CBS 2163
  Vpo VMA C-extein
CGERGNEMAEVLMEFPELFTEMNGKKEPIMKRTTLVANTSNMPVAAREASIYTGITLAEYFRDQGKHV

SEQ ID NO: 1230 - protein, 19 aa, Wiseana iridescent virus
  WIV RIR1 C-extein
CSEIILPTDENRTAVCCLA

SEQ ID NO: 1231 - protein, 73 aa, Zygosaccharomyces bailii, strain CBS 685
  Zba VMA C-extein
CGERGNEMAEVLMEFPELFTEKNGRKEPIMKRTTLVANTSNMPVAAREASIYTGITLAEYFRDQGKNISMIAD

SEQ ID NO: 1232 - protein, 73 aa, Zygosaccharomyces rouxii, strain CBS 688
  Zro VMA C-extein
CGERGNEMAEVLMEFPELFTEVNGHKEPIMKRTTLVANTSNMPVAAREASIYTGITLAEYFRDQGKNISMIAD

SEQ ID NO: 1233 - protein, 6 aa, Aquifex aeolicus strain VF5
  Aae RIR2 Casette
DELCHV

SEQ ID NO: 1234 - protein, 6 aa, Acidovorax avenae subsp. citrulli AAC00-1
  Aave Hyp-1721 Casette
ALFTFK

SEQ ID NO: 1235 - protein, 6 aa, Acidovorax avenae subsp. citrulli AAC00-1
  Aave RIR Casette
TNPCGE

SEQ ID NO: 1236 - protein, 6 aa, Aspergillus brevipes FRR2439
  Abr PRP8 Casette
ERASGF

SEQ ID NO: 1237 - protein, 6 aa, Acidothermus cellulolyticus 11B
  Ace RIR1 Casette
VSACFI

SEQ ID NO: 1238 - protein, 6 aa, Alkalilimnicola ehrlichei MLHE-1
  Aeh DnaB-1 Casette
MGKTTW

SEQ ID NO: 1239 - protein, 6 aa, Alkalilimnicola ehrlichei MLHE-1
  Aeh DnaB-2 Casette
LRESGA

SEQ ID NO: 1240 - protein, 6 aa, Alkalilimnicola ehrlichei MLHE-1
  Aeh Rir1 Casette
TNPCGE

SEQ ID NO: 1241 - protein, 6 aa, Acyrthosiphon pisum secondary endosymbiot phage 1
  AP-APSE1 dpol Casette
GKSCEN

SEQ ID NO: 1242 - protein, 6 aa, Aeropyrum pernix K1
  Ape APE0745 Casette
TTQSAF

SEQ ID NO: 1243 - protein, 6 aa, Acanthomoeba polyphaga Mimivirus
  APMV Pol Casette
YGDTDS

SEQ ID NO: 1244 - protein, 6 aa, Burkholderia cenocepacia
  Bce DnaB Casette
MGKTAF

SEQ ID NO: 1245 - protein, 6 aa, Batrachochytrium dendrobatidis JEL197
  Bde-JEL197 RPB2 Casette
GMVCPA

SEQ ID NO: 1246 - protein, 6 aa, B.subtilis M1918 (prophage)
  BsuP-M1918 RIR1 Casette
SNLCSE

SEQ ID NO: 1247 - protein, 6 aa, B.subtilis strain 168 Sp beta c2 prophage
  BsuP-SPBc2 RIR1 Casette
SNLCSE

SEQ ID NO: 1248 - protein, 6 aa, Clostridium botulinum phage C-St
  CbP-C-St RNR Casette
ASCCRL

SEQ ID NO: 1249 - protein, 6 aa, Clostridium botulinum phage D
  CbP-D RNR Casette
ASCCRL

SEQ ID NO: 1250 - protein, 6 aa, Coxiella burnetii
  Cbu DnaB Casette
LRESGA

SEQ ID NO: 1251 - protein, 6 aa, Chlorobium chlorochromatii CaD3
  Cch RIR1 Casette
SNPCSE

SEQ ID NO: 1252 - protein, 6 aa, Chlamydomonas eugametos (chloroplast)
  Ceu ClpP Casette
QPESSI

SEQ ID NO: 1253 - protein, 6 aa, Candida glabrata
  Cgl VMA Casette
YVGCGE

SEQ ID NO: 1254 - protein, 6 aa, Chilo iridescent virus
  CIV RIR1 Casette
SNLCSE

SEQ ID NO: 1255 - protein, 6 aa, Cryptococcus laurentii strain CBS139
  Cla PRP8 Casette
EKSSGF

SEQ ID NO: 1256 - protein, 6 aa, Filobasidiella neoformans (Cryptococcus neoformans) Serotype A, PHLS_8104
  Cne-A PRP8 (Fne-A PRP8) Casette
EKASGF

SEQ ID NO: 1257 - protein, 6 aa, Cryptococcus neoformans (Filobasidiella neoformans), Serotype AD, CBS132).
  Cne-AD PRP8 (Fne-AD PRP8) Casette
EKASGF

SEQ ID NO: 1258 - protein, 6 aa, Cryptococcus neoformans var. neoformans JEC21
  Cne-JEC21 PRP8 Casette
EKASGF

SEQ ID NO: 1259 - protein, 6 aa, Clostridium thermocellum
  Cth TerA Casette
NGKSEL

SEQ ID NO: 1260 - protein, 6 aa, Candida tropicalis (nucleus)
  Ctr VMA Casette
YVGCGE

SEQ ID NO: 1261 - protein, 6 aa, Chlorella virus NY2A infects Chlorella NC64A, which infects Paramecium bursaria
  CV-NY2A RIR1 Casette
SNLCNE

SEQ ID NO: 1262 - protein, 6 aa, Crocosphaera watsonii WH 8501 (Synechocystis sp. WH 8501)
  Cwa PEP Casette
GRTCHA

SEQ ID NO: 1263 - protein, 6 aa, Crocosphaera watsonii WH 8501 (Synechocystis sp. WH 8501)
  Cwa RIR1 Casette
VNLCTE

SEQ ID NO: 1264 - protein, 6 aa, Costelytra zealandica iridescent virus
  CZIV RIR1 Casette
SNLCSE

SEQ ID NO: 1265 - protein, 6 aa, Dictyostelium discoideum strain AX4 (nucleus)
  Ddi RPC2 Casette
GEACGL

SEQ ID NO: 1266 - protein, 6 aa, Deinococcus geothermalis DSM11300
  Dge DnaB Casette
MGKTAF

SEQ ID NO: 1267 - protein, 6 aa, Desulfitobacterium hafniense DCB-2
  Dha-DCB2 RIR1 Casette
TNPCGE

SEQ ID NO: 1268 - protein, 6 aa, Desulfitobacterium hafniense Y51
  Dha-Y51 RIR1 Casette
TNPCGE

SEQ ID NO: 1269 - protein, 6 aa, Debaryomyces hansenii CBS767
  Dhan GLT1 Casette
MRRCHL

SEQ ID NO: 1270 - protein, 6 aa, Debaryomyces hansenii CBS767
  Dhan VMA Casette
YIGCGE

SEQ ID NO: 1271 - protein, 6 aa, Desulfovibrio vulgaris subsp. vulgaris DP4
  Dvul ParB Casette
HEPCWY

SEQ ID NO: 1272 - protein, 6 aa, Emericella nidulans (anamorph: Aspergillus nidulans) FGSC A4
  Eni-FGSCA4 PRP8 Casette
EKASGF

SEQ ID NO: 1273 - protein, 6 aa, Ferroplasma acidarmanus, taxon:97393 and taxon 261390
  Fac-Fer1 RIR1 Casette
TNPCGE

SEQ ID NO: 1274 - protein, 6 aa, Ferroplasma acidarmanus
  Fac-Fer1 SufB (Fac Pps1) Casette
IEGCTA

SEQ ID NO: 1275 - protein, 6 aa, Frankia alni ACN14a
  Fal DnaB Casette
VGKSTL

SEQ ID NO: 1276 - protein, 6 aa, Guillardia theta (plastid)
  Gth DnaB Casette
ESGSIE

SEQ ID NO: 1277 - protein, 6 aa, Gloeobacter violaceus, PCC 7421
  Gvi DnaB Casette
MGKTAF

SEQ ID NO: 1278 - protein, 6 aa, Gloeobacter violaceus, PCC 7421
  Gvi RIR1-2 Casette
TNPCGE

SEQ ID NO: 1279 - protein, 6 aa, Heterosigma akashiwo virus 01
  HaV01 Pol Casette
YGDTDS

SEQ ID NO: 1280 - protein, 6 aa, Halorhodospira halophila SL1
  Hhal DnaB-1 Casette
MGKTTV

SEQ ID NO: 1281 - protein, 6 aa, Haloarcula marismortui ATCC 43049
  Hma CDC21 Casette
TGKSQM

SEQ ID NO: 1282 - protein, 6 aa, Haloarcula marismortui ATCC 43049
  Hma Pol-II Casette
RRNCDG

SEQ ID NO: 1283 - protein, 6 aa, Haloarcula marismortui ATCC 43049
  Hma PolB Casette
IMNSLY

SEQ ID NO: 1284 - protein, 6 aa, Haloarcula marismortui ATCC 43049
  Hma TopA Casette
GTKTRH

SEQ ID NO: 1285 - protein, 6 aa, Halobacterium salinarum NRC-1
  Hsa-NRC1 CDC21 Casette
TGKSQM

SEQ ID NO: 1286 - protein, 6 aa, Halobacterium salinarum NRC-1
  Hsa-NRC1 Pol-II Casette
RRNCDG

SEQ ID NO: 1287 - protein, 6 aa, Haloferax volcanii DS70
  Hvo PolB Casette
YGDTDS

SEQ ID NO: 1288 - protein, 6 aa, Haloquadratum walsbyi DSM 16790
  Hwa GyrB Casette
AGGSAK

SEQ ID NO: 1289 - protein, 6 aa, Haloquadratum walsbyi DSM 16790
  Hwa MCM-2 Casette
AGLTAA

SEQ ID NO: 1290 - protein, 6 aa, Haloquadratum walsbyi DSM 16790
  Hwa MCM-3 Casette
KMRSED

SEQ ID NO: 1291 - protein, 6 aa, Haloquadratum walsbyi DSM 16790
  Hwa MCM-4 Casette
EQQSIS

SEQ ID NO: 1292 - protein, 6 aa, Haloquadratum walsbyi DSM 16790
  Hwa MCM-1 Casette
TGKSAM

SEQ ID NO: 1293 - protein, 6 aa, Haloquadratum walsbyi DSM 16790
  Hwa Pol-II-1 Casette
RRNCDG

SEQ ID NO: 1294 - protein, 6 aa, Haloquadratum walsbyi DSM 16790
  Hwa Pol-II-2 Casette
RGGSMD

SEQ ID NO: 1295 - protein, 6 aa, Haloquadratum walsbyi DSM 16790
  Hwa PolB-1 Casette
GWNCDD

SEQ ID NO: 1296 - protein, 6 aa, Haloquadratum walsbyi DSM 16790
  Hwa PolB-3 Casette
YGDTDS

SEQ ID NO: 1297 - protein, 6 aa, Haloquadratum walsbyi DSM 16790
  Hwa RIR1-1 Casette
VFQSGG

SEQ ID NO: 1298 - protein, 6 aa, Haloquadratum walsbyi DSM 16790
  Hwa RIR1-2 Casette
PTGTTS

SEQ ID NO: 1299 - protein, 6 aa, Haloquadratum walsbyi DSM 16790
  Hwa rPol A'' Casette
TQMTMN

SEQ ID NO: 1300 - protein, 6 aa, Haloquadratum walsbyi DSM 16790
  Hwa Top6B Casette
REQSRG

SEQ ID NO: 1301 - protein, 6 aa, Invertebrate iridescent virus 6
  IIV6 RIR1 Casette
SNLCSE

SEQ ID NO: 1302 - protein, 6 aa, Kazachstania exigua, formerly Saccharomyces exiguus, strain CBS379
  Kex-CBS379 VMA Casette
YVGCGE

SEQ ID NO: 1303 - protein, 6 aa, Kluyveromyces lactis IFO1267
  Kla-IFO1267 VMA Casette
YVGCGE

SEQ ID NO: 1304 - protein, 6 aa, Kluyveromyces lactis NRRL Y-1140
  Kla-NRRLY1140 VMA Casette
YVGCGE

SEQ ID NO: 1305 - protein, 6 aa, Kineococcus radiotolerans SRS30216
  Kra DnaB Casette
ESGSIE

SEQ ID NO: 1306 - protein, 6 aa, Listonella pelagia phage phiHSIC
  LP-phiHSIC helicase Casette
ATGCGK

SEQ ID NO: 1307 - protein, 6 aa, Mycobacterium avium
  Mav DnaB Casette
VGKSTL

SEQ ID NO: 1308 - protein, 6 aa, Mycobacterium avium 104
  Mav-104 DnaB Casette
VGKSTL

SEQ ID NO: 1309 - protein, 6 aa, Mycobacterium avium subsp. paratuberculosis str. k10
  Mav-PT DnaB Casette
VGKSTL

SEQ ID NO: 1310 - protein, 6 aa, Mycobacterium bovis subsp. bovis AF2122/97
  Mbo-AF2122 DnaB Casette
ESGSLE

SEQ ID NO: 1311 - protein, 6 aa, Mycobacterium bovis subsp. bovis AF2122/97
  Mbo Pps1 Casette
VEGCTA

SEQ ID NO: 1312 - protein, 6 aa, Mycobacterium bovis subsp. bovis AF2122/97
  Mbo RecA Casette
KNKCSP

SEQ ID NO: 1313 - protein, 6 aa, Methylococcus capsulatus Bath, prophage MuMc02
  Mca MupF Casette
GFNCRC

SEQ ID NO: 1314 - protein, 6 aa, Methylococcus capsulatus Bath
  Mca RIR1 Casette
TNPCAE

SEQ ID NO: 1315 - protein, 6 aa, Mycobacterium chitae
  Mch RecA Casette
MFGSPE

SEQ ID NO: 1316 - protein, 6 aa, Methanoculleus marisnigri JR1
  Memar MCM2 Casette
EQQSIS

SEQ ID NO: 1317 - protein, 6 aa, Methanoculleus marisnigri JR1
  Memar Pol-II Casette
RRNCDG

SEQ ID NO: 1318 - protein, 6 aa, Mycobacterium fallax
  Mfa RecA Casette
MFGSPE

SEQ ID NO: 1319 - protein, 6 aa, Mycobacterium flavescens Fla0
  Mfl GyrA Casette
MRYTEA

SEQ ID NO: 1320 - protein, 6 aa, Mycobacterium flavescens, ATCC14474
  Mfl-ATCC14474 RecA Casette
MFGSPE

SEQ ID NO: 1321 - protein, 6 aa, Mycobacterium gastri
  Mga GyrA Casette
MRYTEA

SEQ ID NO: 1322 - protein, 6 aa, Mycobacterium gastri
  Mga RecA Casette
MFGSPE

SEQ ID NO: 1323 - protein, 6 aa, Mycobacterium gastri
  Mga SufB (Mga Pps1) Casette
QYESEV

SEQ ID NO: 1324 - protein, 6 aa, Methanospirillum hungateii JF-1
  Mhu Pol-II Casette
RRNCDG

SEQ ID NO: 1325 - protein, 6 aa, Methanococcus jannaschii (Methanocaldococcus jannaschii DSM 2661)
  Mja GF-6P Casette
IGHSRW

SEQ ID NO: 1326 - protein, 6 aa, Methanococcus jannaschii (Methanocaldococcus jannaschii DSM 2661)
  Mja Helicase Casette
PTLSAG

SEQ ID NO: 1327 - protein, 6 aa, Methanococcus jannaschii (Methanocaldococcus jannaschii DSM 2661)
  Mja Hyp-1 Casette
PAHCFT

SEQ ID NO: 1328 - protein, 6 aa, Methanococcus jannaschii (Methanocaldococcus jannaschii DSM 2661)
  Mja IF2 Casette
HGKTTL

SEQ ID NO: 1329 - protein, 6 aa, Methanococcus jannaschii (Methanocaldococcus jannaschii DSM 2661)
  Mja Klba Casette
HDGCSG

SEQ ID NO: 1330 - protein, 6 aa, Methanococcus jannaschii (Methanocaldococcus jannaschii DSM 2661)
  Mja PEP Casette
GLTCHA

SEQ ID NO: 1331 - protein, 6 aa, Methanococcus jannaschii (Methanocaldococcus jannaschii DSM 2661)
  Mja Pol-1 Casette
DFRSLY

SEQ ID NO: 1332 - protein, 6 aa, Methanococcus jannaschii (Methanocaldococcus jannaschii DSM 2661)
  Mja Pol-2 Casette
LANSVY

SEQ ID NO: 1333 - protein, 6 aa, Methanococcus jannaschii (Methanocaldococcus jannaschii DSM 2661)
  Mja r-Gyr Casette
LGLCTY

SEQ ID NO: 1334 - protein, 6 aa, Methanococcus jannaschii (Methanocaldococcus jannaschii DSM 2661)
  Mja RFC-1 Casette
VGKTTA

SEQ ID NO: 1335 - protein, 6 aa, Methanococcus jannaschii (Methanocaldococcus jannaschii DSM 2661)
  Mja RFC-2 Casette
LNASDE

SEQ ID NO: 1336 - protein, 6 aa, Methanococcus jannaschii (Methanocaldococcus jannaschii DSM 2661)
  Mja RFC-3 Casette
ILSCNY

SEQ ID NO: 1337 - protein, 6 aa, Methanococcus jannaschii (Methanocaldococcus jannaschii DSM 2661)
  Mja RNR-1 Casette
GGQTIF

SEQ ID NO: 1338 - protein, 6 aa, Methanococcus jannaschii (Methanocaldococcus jannaschii DSM 2661)
  Mja RNR-2 Casette
AESTAG

SEQ ID NO: 1339 - protein, 6 aa, Methanococcus jannaschii (Methanocaldococcus jannaschii DSM 2661)
  Mja rPol A' Casette
LCVCPP

SEQ ID NO: 1340 - protein, 6 aa, Methanococcus jannaschii (Methanocaldococcus jannaschii DSM 2661)
  Mja RtcB (Mja Hyp-2) Casette
DINCGV

SEQ ID NO: 1341 - protein, 6 aa, Methanococcus jannaschii (Methanocaldococcus jannaschii DSM 2661)
  Mja TFIIB Casette
MTYTIH

SEQ ID NO: 1342 - protein, 6 aa, Methanococcus jannaschii (Methanocaldococcus jannaschii DSM 2661)
  Mja UDP GD Casette
GGSCFP

SEQ ID NO: 1343 - protein, 6 aa, Methanopyrus kandleri AV19
  Mka CDC48 Casette
VGESEK

SEQ ID NO: 1344 - protein, 6 aa, Methanopyrus kandleri AV19
  Mka RFC Casette
LNASDE

SEQ ID NO: 1345 - protein, 6 aa, Methanopyrus kandleri AV19
  Mka RtcB Casette
DINCGV

SEQ ID NO: 1346 - protein, 6 aa, Methanopyrus kandleri AV19
  Mka VatB Casette
TNYCEA

SEQ ID NO: 1347 - protein, 6 aa, Mycobacterium kansasii
  Mkas GyrA Casette
MRYTEA

SEQ ID NO: 1348 - protein, 6 aa, Mycobacterium leprae, strain TN
  Mle DnaB Casette
VGKSTL

SEQ ID NO: 1349 - protein, 6 aa, Mycobacterium leprae, strain TN
  Mle RecA Casette
MFGSPE

SEQ ID NO: 1350 - protein, 6 aa, Bacteriophage Aaphi23
  MP-Aaphi23 MupF Casette
DFNCRC

SEQ ID NO: 1351 - protein, 6 aa, Mycobacteriophage Bethlehem
  MP-Be DnaB Casette
QDQTKN

SEQ ID NO: 1352 - protein, 6 aa, Mycobacteriophage Bethlehem
  MP-Be gp51 Casette
NHDSRA

SEQ ID NO: 1353 - protein, 6 aa, Mycobacteriophage Catera
  MP-Catera gp206 Casette
ELKTQN

SEQ ID NO: 1354 - protein, 6 aa, Mycobacteriophage CJW1
  MP-Mcjw1 DnaB Casette
NGKTEL

SEQ ID NO: 1355 - protein, 6 aa, Mycobacteriophage Omega
  MP-Omega DnaB Casette
EFKTAV

SEQ ID NO: 1356 - protein, 6 aa, Mycobacteriophage U2
  MP-U2 gp50 Casette
NHDSRA

SEQ ID NO: 1357 - protein, 6 aa, Mycobacterium shimodei
  Msh RecA Casette
MFGSPE

SEQ ID NO: 1358 - protein, 6 aa, Mycobacterium species KMS
  Msp-KMS DnaB Casette
MGKSTL

SEQ ID NO: 1359 - protein, 6 aa, Mycobacterium species KMS
  Msp-KMS GyrA Casette
MRYTEA

SEQ ID NO: 1360 - protein, 6 aa, Mycobacterium species MCS
  Msp-MCS DnaB Casette
MGKSTL

SEQ ID NO: 1361 - protein, 6 aa, Mycobacterium species MCS
  Msp-MCS GyrA Casette
MRYTEA

SEQ ID NO: 1362 - protein, 6 aa, Methanothermobacter thermautotrophicus (Methanobacterium thermoautotrophicum)
  Mth RIR1 Casette
TNPCGE

SEQ ID NO: 1363 - protein, 6 aa, Mycobacterium thermoresistibile
  Mthe RecA Casette
MFGSPE

SEQ ID NO: 1364 - protein, 6 aa, Mycobacterium tuberculosis strains H37Rv & CDC1551
  Mtu SufB (Mtu Pps1) Casette
VEGCTA

SEQ ID NO: 1365 - protein, 6 aa, Mycobacterium tuberculosis, CDC1551
  Mtu-CDC1551 DnaB Casette
ESGSLE

SEQ ID NO: 1366 - protein, 6 aa, Mycobacterium tuberculosis H37Rv
  Mtu-H37Rv DnaB Casette
ESGSLE

SEQ ID NO: 1367 - protein, 6 aa, Mycobacterium tuberculosis H37Rv,Also CDC1551
  Mtu-H37Rv RecA Casette
KNKCSP

SEQ ID NO: 1368 - protein, 6 aa, Mycobacterium tuberculosis So93/sub_species="Canetti"
  Mtu-So93 RecA Casette
KNKCSP

SEQ ID NO: 1369 - protein, 6 aa, Mycobacterium vanbaalenii PYR-1
  Mvan DnaB Casette
MGKSTL

SEQ ID NO: 1370 - protein, 6 aa, Nocardia farcinica IFM 10152
  Nfa DnaB Casette
ESGSLE

SEQ ID NO: 1371 - protein, 6 aa, Nocardia farcinica IFM 10152
  Nfa RIR1 Casette
PVSCFL

SEQ ID NO: 1372 - protein, 6 aa, Neosartorya fischeri
  Nfi PRP8 Casette
ERASGF

SEQ ID NO: 1373 - protein, 6 aa, Neosartorya glabra FRR2163
  Ngl-FR2163 PRP8 Casette
ERASGF

SEQ ID NO: 1374 - protein, 6 aa, Neosartorya glabra FRR1833
  Ngl-FRR1833 PRP8 Casette
ERASGF

SEQ ID NO: 1375 - protein, 6 aa, Natronomonas pharaonis DSM 2160
  Nph CDC21 Casette
TGKSQL

SEQ ID NO: 1376 - protein, 6 aa, Natronomonas pharaonis DSM 2160
  Nph PolB-1 Casette
DLKSLY

SEQ ID NO: 1377 - protein, 6 aa, Natronomonas pharaonis DSM 2160
  Nph PolB-2 Casette
IMNSLY

SEQ ID NO: 1378 - protein, 6 aa, Natronomonas pharaonis DSM 2160
  Nph rPol A'' Casette
TQMTMN

SEQ ID NO: 1379 - protein, 6 aa, Nostoc punctiforme
  Npu GyrB Casette
DIGCGM

SEQ ID NO: 1380 - protein, 6 aa, Neosartorya quadricincta, strain NRRL 4175
  Nqu PRP8 Casette
ERASGF

SEQ ID NO: 1381 - protein, 6 aa, Nocardioides species JS614
  Nsp-JS614 DnaB Casette
MGKSTL

SEQ ID NO: 1382 - protein, 6 aa, Nocardioides species JS614
  Nsp-JS614 TOPRIM Casette
FFHCFG

SEQ ID NO: 1383 - protein, 6 aa, Nostoc species PCC7120, (Anabaena sp. PCC7120)
  Nsp-PCC7120 RIR1 Casette
IRRSAG

SEQ ID NO: 1384 - protein, 6 aa, Pyrococcus abyssi
  Pab CDC21-1 Casette
VAKSQL

SEQ ID NO: 1385 - protein, 6 aa, Pyrococcus abyssi
  Pab CDC21-2 Casette
AGLTAA

SEQ ID NO: 1386 - protein, 6 aa, Pyrococcus abyssi
  Pab IF2 Casette
HGKTTL

SEQ ID NO: 1387 - protein, 6 aa, Pyrococcus abyssi
  Pab KlbA Casette
HDGCMG

SEQ ID NO: 1388 - protein, 6 aa, Pyrococcus abyssi
  Pab Lon Casette
PFQSGG

SEQ ID NO: 1389 - protein, 6 aa, Pyrococcus abyssi
  Pab Moaa Casette
CWYCFF

SEQ ID NO: 1390 - protein, 6 aa, Pyrococcus abyssi
  Pab Pol-II Casette
RRNCDG

SEQ ID NO: 1391 - protein, 6 aa, Pyrococcus abyssi
  Pab RFC-1 Casette
VGKTTA

SEQ ID NO: 1392 - protein, 6 aa, Pyrococcus abyssi
  Pab RFC-2 Casette
ILSCNY

SEQ ID NO: 1393 - protein, 6 aa, Pyrococcus abyssi
  Pab RIR1-1 Casette
GGGTGL

SEQ ID NO: 1394 - protein, 6 aa, Pyrococcus abyssi
  Pab RIR1-2 Casette
GAASGP

SEQ ID NO: 1395 - protein, 6 aa, Pyrococcus abyssi
  Pab RIR1-3 Casette
TNPCGE

SEQ ID NO: 1396 - protein, 6 aa, Pyrococcus abyssi
  Pab RtcB (Pab Hyp-2) Casette
DINCGV

SEQ ID NO: 1397 - protein, 6 aa, Pyrococcus abyssi
  Pab VMA Casette
SGKTVT

SEQ ID NO: 1398 - protein, 6 aa, Pyrococcus furiosus
  Pfu KlbA Casette
HDGCMG

SEQ ID NO: 1399 - protein, 6 aa, Pyrococcus furiosus
  Pfu RIR1-1 Casette
GGGTGL

SEQ ID NO: 1400 - protein, 6 aa, Pyrococcus furiosus
  Pfu RIR1-2 Casette
TNPCGE

SEQ ID NO: 1401 - protein, 6 aa, Pyrococcus furiosus
  Pfu VMA Casette
SGKTVT

SEQ ID NO: 1402 - protein, 6 aa, Pyrococcus horikoshii OT3
  Pho CDC21-1 Casette
VAKSQL

SEQ ID NO: 1403 - protein, 6 aa, Pyrococcus horikoshii OT3
  Pho CDC21-2 Casette
AGLTAA

SEQ ID NO: 1404 - protein, 6 aa, Pyrococcus horikoshii OT3
  Pho IF2 Casette
HGKTTL

SEQ ID NO: 1405 - protein, 6 aa, Pyrococcus horikoshii OT3
  Pho KlbA Casette
HDGCMG

SEQ ID NO: 1406 - protein, 6 aa, Pyrococcus horikoshii OT3
  Pho LHR Casette
AVVSST

SEQ ID NO: 1407 - protein, 6 aa, Pyrococcus horikoshii OT3
  Pho Lon Casette
PFQSGG

SEQ ID NO: 1408 - protein, 6 aa, Pyrococcus horikoshii OT3
  Pho Pol I Casette
LANSYY

SEQ ID NO: 1409 - protein, 6 aa, Pyrococcus horikoshii OT3
  Pho Pol-II Casette
RRNCDG

SEQ ID NO: 1410 - protein, 6 aa, Pyrococcus horikoshii OT3
  Pho r-Gyr Casette
AGLCTY

SEQ ID NO: 1411 - protein, 6 aa, Pyrococcus horikoshii OT3
  Pho RadA Casette
SGKTQL

SEQ ID NO: 1412 - protein, 6 aa, Pyrococcus horikoshii OT3
  Pho RFC Casette
VGKTTA

SEQ ID NO: 1413 - protein, 6 aa, Pyrococcus horikoshii OT3
  Pho RIR1 Casette
TNPCGE

SEQ ID NO: 1414 - protein, 6 aa, Pyrococcus horikoshii OT3
  Pho VMA Casette
SGKTVT

SEQ ID NO: 1415 - protein, 6 aa, Pelodictyon luteolum DSM 273
  Plut RIR1 Casette
SNPCSE

SEQ ID NO: 1416 - protein, 6 aa, Polaromonas naphthalenivorans CJ2
  Pna RIR1 Casette
TNPCGE

SEQ ID NO: 1417 - protein, 6 aa, Polaromonas species JS666
  Posp-JS666 RIR1 Casette
TNPCGE

SEQ ID NO: 1418 - protein, 6 aa, Pseudomonas aeruginosa phage phiEL
  PP-PhiEL Helicase Casette
SGKTFT

SEQ ID NO: 1419 - protein, 6 aa, Pseudomonas aeruginosa phage phiEL
  PP-PhiEL ORF11 Casette
QGKTVS

SEQ ID NO: 1420 - protein, 6 aa, Pseudomonas aeruginosa phage phiEL
  PP-PhiEL ORF39 Casette
AGKSLT

SEQ ID NO: 1421 - protein, 6 aa, Pseudomonas aeruginosa phage phiEL
  PP-PhiEL ORF40 Casette
FGKTYM

SEQ ID NO: 1422 - protein, 6 aa, Porphyra purpurea (chloroplast)
  Ppu DnaB Casette
ESGSIE

SEQ ID NO: 1423 - protein, 6 aa, Pyrococcus species GB-D
  Psp-GBD Pol Casette
LANSYY

SEQ ID NO: 1424 - protein, 6 aa, Pichia stipitis CBS 6054, taxon:322104
  Pst VMA Casette
YVGCGE

SEQ ID NO: 1425 - protein, 6 aa, Pseudomonas syringae pv. tomato str. DC3000
  Psy Fha Casette
GPCTGP

SEQ ID NO: 1426 - protein, 6 aa, Picrophilus torridus, DSM 9790
  Pto VMA Casette
SGKTVI

SEQ ID NO: 1427 - protein, 6 aa, Porphyra yezoensis chloroplast, cultivar U-51
  Pye DnaB Casette
ESGSIE

SEQ ID NO: 1428 - protein, 6 aa, Roseovarius species 217
  Rsp Rir1 Casette
TNPCGE

SEQ ID NO: 1429 - protein, 6 aa, Salmonella phage SETP12
  SaP-SETP12 dpol Casette
GKACEL

SEQ ID NO: 1430 - protein, 6 aa, Salmonella phage SETP3
  SaP-SETP3 dpol Casette
GKACEL

SEQ ID NO: 1431 - protein, 6 aa, Salmonella phage SETP3
  SaP-SETP3 Helicase Casette
SGKSST

SEQ ID NO: 1432 - protein, 6 aa, Salmonella phage SETP5
  SaP-SETP5 dpol Casette
GKACEL

SEQ ID NO: 1433 - protein, 6 aa, Streptomyces avermitilis MA-4680
  Sav Helicase Casette
SGKTMV

SEQ ID NO: 1434 - protein, 6 aa, Saccharomyces castellii, strain CBS4309
  Sca-CBS4309 VMA Casette
YVGCGE

SEQ ID NO: 1435 - protein, 6 aa, Saccharomyces cariocanus, strain="UFRJ 50791
  Scar VMA Casette
YVGCGE

SEQ ID NO: 1436 - protein, 6 aa, Saccharomyces cerevisiae (nucleus)
  Sce VMA Casette
YVGCGE

SEQ ID NO: 1437 - protein, 6 aa, Saccharomyces cerevisiae strain DH1-1A
  Sce-DH1-1A VMA Casette
YVGCGE

SEQ ID NO: 1438 - protein, 6 aa, Saccharomyces cerevisiae OUT7091
  Sce-OUT7091 VMA Casette
YVGCGE

SEQ ID NO: 1439 - protein, 6 aa, Saccharomyces cerevisiae OUT7112
  Sce-OUT7112 VMA Casette
YVGCGE

SEQ ID NO: 1440 - protein, 6 aa, Saccharomyces dairenensis, strain CBS 421
  Sda VMA Casette
YVGCGE

SEQ ID NO: 1441 - protein, 6 aa, Staphylococcus epidermidis RP62A
  Sep RIR1 Casette
SNLCTE

SEQ ID NO: 1442 - protein, 6 aa, Saccharomyces exiguus, strain="IFO1128"
  Sex-IFO1128 VMA Casette
YVGCGE

SEQ ID NO: 1443 - protein, 6 aa, Stigeoclonium helveticum, strain UTEX 441
  She RPB2 (RpoB) Casette
KIHSRS

SEQ ID NO: 1444 - protein, 6 aa, Shigella flexneri 5 str. 8401
  ShP-Sfv-5 Primase Casette
HGKTEV

SEQ ID NO: 1445 - protein, 6 aa, Staphylothermus marinus F1
  Smar 1471 Casette
AMATGH

SEQ ID NO: 1446 - protein, 6 aa, Staphylothermus marinus F1
  Smar MCM2 Casette
EQQTVS

SEQ ID NO: 1447 - protein, 6 aa, Saccharomyces pastorianus IFO11023
  Spa VMA Casette
YVGCGE

SEQ ID NO: 1448 - protein, 6 aa, Spirulina platensis, strain C1
  Spl DnaX Casette
IDECHM

SEQ ID NO: 1449 - protein, 6 aa, Salinibacter ruber DSM 13855
  Sru DnaB Casette
MGKTAF

SEQ ID NO: 1450 - protein, 6 aa, Salinibacter ruber DSM 13855
  Sru PolBc Casette
LINSFY

SEQ ID NO: 1451 - protein, 6 aa, Synechocystis species, strain PCC6803
  Ssp DnaX Casette
IDECHM

SEQ ID NO: 1452 - protein, 6 aa, Synechocystis species, strain PCC6803
  Ssp GyrB Casette
AGGSAK

SEQ ID NO: 1453 - protein, 6 aa, Synechococcus species JA-2-3B'a(2-13)
  Ssp-JA2 DnaB Casette
ESGSIE

SEQ ID NO: 1454 - protein, 6 aa, Synechococcus species JA-2-3B'a(2-13)
  Ssp-JA2 RIR1 Casette
LNPCGE

SEQ ID NO: 1455 - protein, 6 aa, Synechococcus species JA-3-3Ab
  Ssp-JA3 DnaB Casette
ESGSIE

SEQ ID NO: 1456 - protein, 6 aa, Synechococcus species JA-3-3Ab
  Ssp-JA3 RIR1 Casette
LNPCGE

SEQ ID NO: 1457 - protein, 6 aa, Staphylococcus phage Twort
  StP-Twort ORF6 Casette
GGKTEC

SEQ ID NO: 1458 - protein, 6 aa, Saccharomyces unisporus, strain CBS 398
  Sun VMA Casette
YVGCGE

SEQ ID NO: 1459 - protein, 6 aa, Thermoplasma acidophilum, ATCC 25905
  Tac-ATCC25905 VMA Casette
SGKTVI

SEQ ID NO: 1460 - protein, 6 aa, Thermoplasma acidophilum, DSM1728
  Tac-DSM1728 VMA Casette
SGKTVI

SEQ ID NO: 1461 - protein, 6 aa, Thermococcus aggregans
  Tag Pol-1 (Tsp-TY Pol-1) Casette
DFRSLY

SEQ ID NO: 1462 - protein, 6 aa, Thermococcus aggregans
  Tag Pol-2 (Tsp-TY Pol-2) Casette
LANSYY

SEQ ID NO: 1463 - protein, 6 aa, Trichodesmium erythraeum IMS101
  Ter DnaB-1 Casette
MGKTSF

SEQ ID NO: 1464 - protein, 6 aa, Trichodesmium erythraeum IMS101
  Ter DnaE-1 Casette
GVLCYQ

SEQ ID NO: 1465 - protein, 6 aa, Trichodesmium erythraeum IMS101
  Ter GyrB Casette
ASGSAK

SEQ ID NO: 1466 - protein, 6 aa, Trichodesmium erythraeum IMS101
  Ter Ndse-1 Casette
IRSCYD

SEQ ID NO: 1467 - protein, 6 aa, Trichodesmium erythraeum IMS101
  Ter Ndse-2 Casette
IFNTYG

SEQ ID NO: 1468 - protein, 6 aa, Trichodesmium erythraeum IMS101
  Ter Snf2 Casette
LGKTIQ

SEQ ID NO: 1469 - protein, 6 aa, Trichodesmium erythraeum IMS101
  Ter ThyX Casette
IGCSFD

SEQ ID NO: 1470 - protein, 6 aa, Thermococcus fumicolans
  Tfu Pol-1 Casette
DFRSLY

SEQ ID NO: 1471 - protein, 6 aa, Thermococcus fumicolans
  Tfu Pol-2 Casette
YADTDG

SEQ ID NO: 1472 - protein, 6 aa, Thermobifida fusca YX
  Tfus Hyp-2914 Casette
IGYSFG

SEQ ID NO: 1473 - protein, 6 aa, Thermobifida fusca YX
  Tfus RecA-1 Casette
SGKTTV

SEQ ID NO: 1474 - protein, 6 aa, Thermobifida fusca YX
  Tfus RecA-2 Casette
MFGSPE

SEQ ID NO: 1475 - protein, 6 aa, Torulaspora globosa, strain CBS 764
  Tgl VMA Casette
YVGCGE

SEQ ID NO: 1476 - protein, 6 aa, Thermococcus hydrothermalis
  Thy Pol-1 Casette
LANSYY

SEQ ID NO: 1477 - protein, 6 aa, Thermococcus hydrothermalis
  Thy Pol-2 Casette
YADTDG

SEQ ID NO: 1478 - protein, 6 aa, Thermococcus kodakaraensis KOD1
  Tko CDC21-1 Casette
AGLTAA

SEQ ID NO: 1479 - protein, 6 aa, Thermococcus kodakaraensis KOD1
  Tko CDC21-2 Casette
EQQTIS

SEQ ID NO: 1480 - protein, 6 aa, Thermococcus kodakaraensis KOD1
  Tko IF2 Casette
HGKTTL

SEQ ID NO: 1481 - protein, 6 aa, Thermococcus kodakaraensis KOD1
  Tko KlbA Casette
HNGCMG

SEQ ID NO: 1482 - protein, 6 aa, Thermococcus kodakaraensis KOD1
  Tko LHR Casette
AVVSST

SEQ ID NO: 1483 - protein, 6 aa, Pyrococcus/ Thermococcus kodakaraensis KOD1
  Tko Pol-1 (Pko Pol-1) Casette
DFRSLY

SEQ ID NO: 1484 - protein, 6 aa, Pyrococcus/Thermococcus kodakaraensis KOD1
  Tko Pol-2 (Pko Pol-2) Casette
LANSYY

SEQ ID NO: 1485 - protein, 6 aa, Thermococcus kodakaraensis KOD1
  Tko Pol-II Casette
RRNCDG

SEQ ID NO: 1486 - protein, 6 aa, Thermococcus kodakaraensis KOD1
  Tko r-Gyr Casette
AGLCTY

SEQ ID NO: 1487 - protein, 6 aa, Thermococcus kodakaraensis KOD1
  Tko RadA Casette
SGKTQL

SEQ ID NO: 1488 - protein, 6 aa, Thermococcus kodakaraensis KOD1
  Tko RIR1-1 Casette
GGGTGL

SEQ ID NO: 1489 - protein, 6 aa, Thermococcus kodakaraensis KOD1
  Tko RIR1-2 Casette
TNPCGE

SEQ ID NO: 1490 - protein, 6 aa, Thermococcus kodakaraensis KOD1
  Tko TopA Casette
KGYCSY

SEQ ID NO: 1491 - protein, 6 aa, Thermococcus litoralis
  Tli Pol-1 Casette
LANSYY

SEQ ID NO: 1492 - protein, 6 aa, Thermococcus litoralis
  Tli Pol-2 Casette
YADTDG

SEQ ID NO: 1493 - protein, 6 aa, Torulaspora pretoriensis, strain CBS 5080
  Tpr VMA Casette
YVGCGE

SEQ ID NO: 1494 - protein, 6 aa, Thermococcus species GE8
  Tsp-GE8 Pol-1 Casette
LANSYY

SEQ ID NO: 1495 - protein, 6 aa, Thermococcus species GE8
  Tsp-GE8 Pol-2 Casette
YADTDG

SEQ ID NO: 1496 - protein, 6 aa, Thermococcus species GT
  Tsp-GT Pol-1 Casette
LANSYY

SEQ ID NO: 1497 - protein, 6 aa, Thermococcus species GT
  Tsp-GT Pol-2 Casette
YADTDG

SEQ ID NO: 1498 - protein, 6 aa, Thermus thermophilus HB27
  Tth-HB27 DnaE-1 Casette
LRRSMG

SEQ ID NO: 1499 - protein, 6 aa, Thermus thermophilus HB27
  Tth-HB27 DnaE-2 Casette
FNKSHA

SEQ ID NO: 1500 - protein, 6 aa, Thermus thermophilus HB27
  Tth-HB27 RIR1-1 Casette
QGGTRR

SEQ ID NO: 1501 - protein, 6 aa, Thermus thermophilus HB27
  Tth-HB27 RIR1-2 Casette
TNPCGE

SEQ ID NO: 1502 - protein, 6 aa, Thermus thermophilus HB8
  Tth-HB8 DnaE-1 Casette
LRRSMG

SEQ ID NO: 1503 - protein, 6 aa, Thermus thermophilus HB8
  Tth-HB8 DnaE-2 Casette
FNKSHA

SEQ ID NO: 1504 - protein, 6 aa, Thermus thermophilus HB8
  Tth-HB8 RIR1-2 Casette
TNPCGE

SEQ ID NO: 1505 - protein, 6 aa, Thermococcus zilligii
  Tzi Pol Casette
LANSYY

SEQ ID NO: 1506 - protein, 6 aa, uncultured archaeon GZfos13E1
  Unc-ERS PFL Casette
CPYCHN

SEQ ID NO: 1507 - protein, 6 aa, uncultured archaeon GZfos9C4
  Unc-ERS RIR1 Casette
TNPCGE

SEQ ID NO: 1508 - protein, 6 aa, uncultured archaeon (Rice Cluster I)
  Unc-MetRFS MCM2 Casette
EQQSIS

SEQ ID NO: 1509 - protein, 6 aa, Vanderwaltozyma polyspora, formerly Kluyveromyces polysporus, strain CBS 2163
  Vpo VMA Casette
YVGCGE

SEQ ID NO: 1510 - protein, 6 aa, Wiseana iridescent virus
  WIV RIR1 Casette
SNLCSE

SEQ ID NO: 1511 - protein, 6 aa, Zygosaccharomyces bailii, strain CBS 685
  Zba VMA Casette
YVGCGE

SEQ ID NO: 1512 - protein, 6 aa, Zygosaccharomyces rouxii, strain CBS 688
  Zro VMA Casette
YVGCGE

SEQ ID NO: 1513 - protein, 6 aa, Artificial Sequence
  Synthetic Construct, consensus motif 1
GGKCGG

SEQ ID NO: 1514 - protein, 6 aa, Artificial Sequence
  Synthetic Construct, consensus motif 2
GGKSGG

SEQ ID NO: 1515 - protein, 6 aa, Artificial Sequence
  Synthetic Construct, consensus motif 3
GGKTGG

SEQ ID NO: 1516 - protein, 6 aa, Artificial Sequence
  Synthetic Construct, P77853-T134-1
PGATSP

SEQ ID NO: 1517 - protein, 6 aa, Artificial Sequence
  Synthetic Construct, P77853-T134-2
PGATVP

SEQ ID NO: 1518 - protein, 7 aa, Artificial Sequence
  Synthetic Construct, P77853-T134-3
PGAKSLG

SEQ ID NO: 1519 - protein, 6 aa, Artificial Sequence
  Synthetic Construct, P77853-T134-4
PGATSL

SEQ ID NO: 1520 - protein, 6 aa, Artificial Sequence
  Synthetic Construct, P77853-T134-5
PGASPL

SEQ ID NO: 1521 - protein, 6 aa, Artificial Sequence
  Synthetic Construct, P77853-T134-6
PGATGP

SEQ ID NO: 1522 - protein, 8 aa, Artificial Sequence
  Synthetic Construct, P77853-T134-7
PGAQRSLG

SEQ ID NO: 1523 - protein, 6 aa, Artificial Sequence
  Synthetic Construct, P77853-S158-1
NQPSIV

SEQ ID NO: 1524 - protein, 6 aa, Artificial Sequence
  Synthetic Construct, P77853-S158-2
NQASIV

SEQ ID NO: 1525 - protein, 6 aa, Artificial Sequence
  Synthetic Construct, P26222-S43-1
PNMSSA

SEQ ID NO: 1526 - protein, 6 aa, Artificial Sequence
  Synthetic Construct, P26222-S115-1
GNHSSG

SEQ ID NO: 1527 - protein, 6 aa, Artificial Sequence
  Synthetic Construct, P26222-S123-1
PSHSAY

SEQ ID NO: 1528 - protein, 6 aa, Artificial Sequence
  Synthetic Construct, P26222-S154-1
SLMSSC

SEQ ID NO: 1529 - protein, 6 aa, Artificial Sequence
  Synthetic Construct, P26222-S220-1
TNTSNY

SEQ ID NO: 1530 - protein, 6 aa, Artificial Sequence
  Synthetic Construct, P26222-S251-1
IDTSRN

SEQ ID NO: 1531 - protein, 6 aa, Artificial Sequence
  Synthetic Construct, P26222-S123-2
PSTSAY

SEQ ID NO: 1532 - protein, 6 aa, Artificial Sequence
  Synthetic Construct, P54583-S56-1
QIKSLG

SEQ ID NO: 1533 - protein, 6 aa, Artificial Sequence
  Synthetic Construct, P54583-C75-1
FETCNY

SEQ ID NO: 1534 - protein, 6 aa, Artificial Sequence
  Synthetic Construct, P54583-S192-1
AVLSVN

SEQ ID NO: 1535 - protein, 6 aa, Artificial Sequence
  Synthetic Construct, P54583-S237-1
LVYSAH

SEQ ID NO: 1536 - protein, 6 aa, Artificial Sequence
  Synthetic Construct, O77044-S84-1
AGYSSA

SEQ ID NO: 1537 - protein, 6 aa, Artificial Sequence
  Synthetic Construct, O77044-T303-1
MWGTLR

SEQ ID NO: 1538 - protein, 6 aa, Artificial Sequence
  Synthetic Construct, O77044-S325-1
LSASSY

SEQ ID NO: 1539 - protein, 6 aa, Artificial Sequence
  Synthetic Construct, O77044-T333-1
FAQTQI

SEQ ID NO: 1540 - protein, 6 aa, Artificial Sequence
  Synthetic Construct, O77044-S345-1
GGRSFV

SEQ ID NO: 1541 - protein, 6 aa, Artificial Sequence
  Synthetic Construct, O77044-C348-1
SFVCGF

SEQ ID NO: 1542 - protein, 6 aa, Artificial Sequence
  Synthetic Construct, O77044-S352-1
GFGSNP

SEQ ID NO: 1543 - protein, 6 aa, Artificial Sequence
  Synthetic Construct, O77044-T356-1
NPPTRP

SEQ ID NO: 1544 - protein, 6 aa, Artificial Sequence
  Synthetic Construct, O77044-S362-1
HHRSSS

SEQ ID NO: 1545 - protein, 6 aa, Artificial Sequence
  Synthetic Construct, O77044-S363-1
HRSSSC

SEQ ID NO: 1546 - protein, 6 aa, Artificial Sequence
  Synthetic Construct, O77044-S364-1
RSSSCP

SEQ ID NO: 1547 - protein, 6 aa, Artificial Sequence
  Synthetic Construct, O77044-T376-1
DWNTFN

SEQ ID NO: 1548 - protein, 6 aa, Artificial Sequence
  Synthetic Construct, O77044-S379-1
TFNSPD

SEQ ID NO: 1549 - protein, 6 aa, Artificial Sequence
  Synthetic Construct, O77044-S406-1
DDRSDY

SEQ ID NO: 1550 - protein, 6 aa, Artificial Sequence
  Synthetic Construct, O77044-T415-1
EVATDY

SEQ ID NO: 1551 - protein, 6 aa, Artificial Sequence
  Synthetic Construct, O30700-T309-1
NQVTEL

SEQ ID NO: 1552 - protein, 6 aa, Artificial Sequence
  Synthetic Construct, O30700-T360-1
SSVTFW

SEQ ID NO: 1553 - protein, 6 aa, Artificial Sequence
  Synthetic Construct, O30700-S215-1
LRESVW

SEQ ID NO: 1554 - protein, 6 aa, Artificial Sequence
  Synthetic Construct, O30700-T137-1
RFHTLV

SEQ ID NO: 1555 - protein, 6 aa, Artificial Sequence
  Synthetic Construct, O30700-S358-1
DLSSVT

SEQ ID NO: 1556 - protein, 6 aa, Artificial Sequence
  Synthetic Construct, O30700-T369-1
DNHTWL

SEQ ID NO: 1557 - protein, 6 aa, Artificial Sequence
  Synthetic Construct, O30700-T250-1
DYNTEV

SEQ ID NO: 1558 - protein, 6 aa, Artificial Sequence
  Synthetic Construct, O30700-S314-1
LDVSLY

SEQ ID NO: 1559 - protein, 6 aa, Artificial Sequence
  Synthetic Construct, O30700-S95-1
HYNSIV

SEQ ID NO: 1560 - protein, 6 aa, Artificial Sequence
  Synthetic Construct, O30700-S357-1
ADLSSV

SEQ ID NO: 1561 - protein, 6 aa, Artificial Sequence
  Synthetic Construct, P40942-T292-1
NIITEL

SEQ ID NO: 1562 - protein, 6 aa, Artificial Sequence
  Synthetic Construct, P40942-T263-1
GHQTHI

SEQ ID NO: 1563 - protein, 6 aa, Artificial Sequence
  Synthetic Construct, P40942-S198-1
MRNSPW

SEQ ID NO: 1564 - protein, 6 aa, Artificial Sequence
  Synthetic Construct, P40942-T122-1
RFHTLV

SEQ ID NO: 1565 - protein, 6 aa, Artificial Sequence
  Synthetic Construct, P40942-T233-1
DYNTDD

SEQ ID NO: 1566 - protein, 6 aa, Artificial Sequence
  Synthetic Construct, P40942-S350-1
DKYSWL

SEQ ID NO: 1567 - protein, 6 aa, Artificial Sequence
  Synthetic Construct, P40942-S297-1
LDMSIY

SEQ ID NO: 1568 - protein, 6 aa, Artificial Sequence
  Synthetic Construct, P40942-T129-1
HNQTPT

SEQ ID NO: 1569 - protein, 6 aa, Artificial Sequence
  Synthetic Construct, P40942-S179-1
DIKSWD

SEQ ID NO: 1570 - protein, 6 aa, Artificial Sequence
  Synthetic Construct, P40942-S346-1
WGISDK

SEQ ID NO: 1571 - protein, 6 aa, Artificial Sequence
  Synthetic Construct, O43097-T134-1
SGATDL

SEQ ID NO: 1572 - protein, 6 aa, Artificial Sequence
  Synthetic Construct, O43097-S47-1
YYYSWW

SEQ ID NO: 1573 - protein, 6 aa, Artificial Sequence
  Synthetic Construct, O43097-S50-1
SWWSDG

SEQ ID NO: 1574 - protein, 6 aa, Artificial Sequence
  Synthetic Construct, O43097-T126-1
NFGTYD

SEQ ID NO: 1575 - protein, 6 aa, Artificial Sequence
  Synthetic Construct, O43097-T152-1
GKTTRV

SEQ ID NO: 1576 - protein, 6 aa, Artificial Sequence
  Synthetic Construct, O43097-S158-1
NAPSID

SEQ ID NO: 1577 - protein, 6 aa, Artificial Sequence
  Synthetic Construct, O43097-T164-1
GTQTFD

SEQ ID NO: 1578 - protein, 6 aa, Artificial Sequence
  Synthetic Construct, O43097-S170-1
QYWSVR

SEQ ID NO: 1579 - protein, 6 aa, Artificial Sequence
  Synthetic Construct, O43097-T208-1
IVATEG

SEQ ID NO: 1580 - protein, 6 aa, Artificial Sequence
  Synthetic Construct, O43097-S213-1
GYFSSG

SEQ ID NO: 1581 - protein, 6 aa, Artificial Sequence
  Synthetic Construct, O43097-S103-1
NGNSYL

SEQ ID NO: 1582 - protein, 6 aa, Artificial Sequence
  Synthetic Construct, O43097-T111-1
YGWTRN

SEQ ID NO: 1583 - protein, 6 aa, Artificial Sequence
  Synthetic Construct, O43097-S130-1
YDPSSG

SEQ ID NO: 1584 - protein, 6 aa, Artificial Sequence
  Synthetic Construct, O43097-T151-1
LGKTTR

SEQ ID NO: 1585 - protein, 6 aa, Artificial Sequence
  Synthetic Construct, O43097-S214-1
YFSSGY

SEQ ID NO: 1586 - protein, 6 aa, Artificial Sequence
  Synthetic Construct, O68438-T788-1
IDHTDS

SEQ ID NO: 1587 - protein, 6 aa, Artificial Sequence
  Synthetic Construct, O68438-T793-1
SWSTNE

SEQ ID NO: 1588 - protein, 6 aa, Artificial Sequence
  Synthetic Construct, O68438-S790-1
HTDSWS

SEQ ID NO: 1589 - protein, 6 aa, Artificial Sequence
  Synthetic Construct, O68438-T797-1
NEITIN

SEQ ID NO: 1590 - protein, 6 aa, Artificial Sequence
  Synthetic Construct, O68438-S792-1
DSWSTN

SEQ ID NO: 1591 - protein, 6 aa, Artificial Sequence
  Synthetic Construct, O68438-S723-1
LDQSYV

SEQ ID NO: 1592 - protein, 6 aa, Artificial Sequence
  Synthetic Construct, O68438-T769-1
EDPTIT

SEQ ID NO: 1593 - protein, 6 aa, Artificial Sequence
  Synthetic Construct, O68438-T726-1
SYVTGY

SEQ ID NO: 1594 - protein, 6 aa, Artificial Sequence
  Synthetic Construct, O68438-S680-1
PWGSNS

SEQ ID NO: 1595 - protein, 6 aa, Artificial Sequence
  Synthetic Construct, O68438-S682-1
GSNSFI

SEQ ID NO: 1596 - protein, 6 aa, Artificial Sequence
  Synthetic Construct, O68438-S547-1
TPGSGG

SEQ ID NO: 1597 - protein, 6 aa, Artificial Sequence
  Synthetic Construct, O68438-S298-1
TNYSHP

SEQ ID NO: 1598 - protein, 6 aa, Artificial Sequence
  Synthetic Construct, O68438-S712-1
DGMSYL

SEQ ID NO: 1599 - protein, 6 aa, Artificial Sequence
  Synthetic Construct, O68438-S783-1
PQKCYI

SEQ ID NO: 1600 - protein, 6 aa, Artificial Sequence
  Synthetic Construct, P26222-S151-1
DLISLM

SEQ ID NO: 1601 - protein, 6 aa, Artificial Sequence
  Synthetic Construct, P26222-S155-1
LMSSCM

SEQ ID NO: 1602 - protein, 6 aa, Artificial Sequence
  Synthetic Construct, P26222-S180-1
AGSSQA

SEQ ID NO: 1603 - protein, 6 aa, Artificial Sequence
  Synthetic Construct, P26222-S191-1
AGHSAW

SEQ ID NO: 1604 - protein, 6 aa, Artificial Sequence
  Synthetic Construct, P26222-T217-1
GIATNT

SEQ ID NO: 1605 - protein, 6 aa, Artificial Sequence
  Synthetic Construct, P26222-T219-1
ATNTSN

SEQ ID NO: 1606 - protein, 6 aa, Artificial Sequence
  Synthetic Construct, P26222-S266-1
CDPSGR

SEQ ID NO: 1607 - protein, 6 aa, Artificial Sequence
  Synthetic Construct, P26222-T71-1
PQGTWF

SEQ ID NO: 1608 - protein, 6 aa, Artificial Sequence
  Synthetic Construct, P26222-T250-1
VIDTSR

SEQ ID NO: 1609 - protein, 6 aa, Artificial Sequence
  Synthetic Construct, P54583-T133-1
QGLTSL

SEQ ID NO: 1610 - protein, 6 aa, Artificial Sequence
  Synthetic Construct, P54583-S165-1
SGQSAL

SEQ ID NO: 1611 - protein, 6 aa, Artificial Sequence
  Synthetic Construct, P54583-S251-1
NGDSYW

SEQ ID NO: 1612 - protein, 6 aa, Artificial Sequence
  Synthetic Construct, P54583-T369-1
SGDTGG

SEQ ID NO: 1613 - protein, 6 aa, Artificial Sequence
  Synthetic Construct, P54583-S246-1
GVQSYN

SEQ ID NO: 1614 - protein, 6 aa, Artificial Sequence
  Synthetic Construct, P54583-S277-1
LVYSAH

SEQ ID NO: 1615 - protein, 6 aa, Artificial Sequence
  Synthetic Construct, P54583-T326-1
EFGTTL

SEQ ID NO: 1616 - protein, 6 aa, Artificial Sequence
  Synthetic Construct, P54583-T358-1
FQWTFW

SEQ ID NO: 1617 - protein, 6 aa, Artificial Sequence
  Synthetic Construct, P54583-T361-1
TFWSWN

SEQ ID NO: 1618 - protein, 6 aa, Artificial Sequence
  Synthetic Construct, P54583-S366-1
NPDSGD

SEQ ID NO: 1619 - protein, 6 aa, Artificial Sequence
  Synthetic Construct, P77853-S212-1
GYQSSG

SEQ ID NO: 1620 - protein, 6 aa, Artificial Sequence
  Synthetic Construct, P77853-S124-1
IVESWG

SEQ ID NO: 1621 - protein, 6 aa, Artificial Sequence
  Synthetic Construct, P77853-T113-1
GWSTNP

SEQ ID NO: 1622 - protein, 6 aa, Artificial Sequence
  Synthetic Construct, P77853-T199-1
NLGTID

SEQ ID NO: 1623 - protein, 6 aa, Artificial Sequence
  Synthetic Construct, P77853-T52-1
TGNTTM

SEQ ID NO: 1624 - protein, 6 aa, Artificial Sequence
  Synthetic Construct, P77853-S104-1
NGNSYL

SEQ ID NO: 1625 - protein, 6 aa, Artificial Sequence
  Synthetic Construct, P77853-S112-1
YGWSTN

SEQ ID NO: 1626 - protein, 6 aa, Artificial Sequence
  Synthetic Construct, P77853-S213-1
YQSSGS

SEQ ID NO: 1627 - protein, 6 aa, Artificial Sequence
  Synthetic Construct, P77853-S35-1
SNASGT

SEQ ID NO: 1628 - protein, 6 aa, Artificial Sequence
  Synthetic Construct, P77853-T145-1
DGGTYD

SEQ ID NO: 1629 - protein, 784 aa, Artificial Sequence
  Synthetic Construct, P77853-Tth-T134-1
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVACHLAPPEERVTLLALLLGDGNTKPSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1630 - protein, 784 aa, Artificial Sequence
  Synthetic Construct, P77853-Tth-T134-2
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1631 - protein, 784 aa, Artificial Sequence
  Synthetic Construct, P77853-Tth-T134-3
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRLGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRASEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1632 - protein, 784 aa, Artificial Sequence
  Synthetic Construct, P77853-Tth-T134-9
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYIHPTTGVVTLATLAPRPGAQDPVKRLVVEAGMVAKAEEKRVPEEVFRYRREALALYLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1633 - protein, 783 aa, Artificial Sequence
  Synthetic Construct, P77853-Tth-T134-12
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYILYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNKSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1634 - protein, 784 aa, Artificial Sequence
  Synthetic Construct, P77853-Tth-T134-36
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1635 - protein, 784 aa, Artificial Sequence; identical to SEQ ID NO: 1634
  Synthetic Construct, P77853-Tth-T134-42

SEQ ID NO: 1636 - protein, 783 aa, Artificial Sequence
  Synthetic Construct, P77853-Tth-T134-43
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHLLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1637 - protein, 783 aa, Artificial Sequence; identical to SEQ ID NO: 1636
  Synthetic Construct, P77853-Tth-T134-45

SEQ ID NO: 1638 - protein, 784 aa, Artificial Sequence
  Synthetic Construct, P77853-Tth-T134-48
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVSDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRHVVEAGMVAKAEEKRVPEEVFRYRREALALSLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLSRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1639 - protein, 783 aa, Artificial Sequence
  Synthetic Construct, P77853-Tth-T134-49
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPIAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1640 - protein, 783 aa, Artificial Sequence
  Synthetic Construct, P77853-Tth-T134-80
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERGTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1641 - protein, 784 aa, Artificial Sequence; identical to SEQ ID NO: 1634
  Synthetic Construct, P77853-Tth-T134-82

SEQ ID NO: 1642 - protein, 784 aa, Artificial Sequence
  Synthetic Construct, P77853-Tth-T134-83
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGAYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1643 - protein, 784 aa, Artificial Sequence
  Synthetic Construct, P77853-Tth-T134-89
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVATLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALETEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1644 - protein, 783 aa, Artificial Sequence
  Synthetic Construct, P77853-Tth-T134-91
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSATLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNKSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1645 - protein, 783 aa, Artificial Sequence
  Synthetic Construct, P77853-Tth-T134-95
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNASFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGIRSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNKSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1646 - protein, 783 aa, Artificial Sequence
  Synthetic Construct, P77853-Tth-T134-98
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVSEVLESGVREVVRLRTRSGRTLVLTPDHLLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1647 - protein, 784 aa, Artificial Sequence; identical to SEQ ID NO: 1634
  Synthetic Construct, P77853-Tth-T134-100

SEQ ID NO: 1648 - protein, 784 aa, Artificial Sequence
  Synthetic Construct, P77853-Tth-T134-108
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAEVPVAGHLAPPEERVTLLALLLGDGNTKLSGRRGTRPNAFFYSKDPELLAAYRRCAEASGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSIGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTGPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1649 - protein, 784 aa, Artificial Sequence
  Synthetic Construct, P77853-Tth-T134-110
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVPPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1650 - protein, 783 aa, Artificial Sequence
  Synthetic Construct, P77853-Tth-T134-119
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHTLLTPEGWKPLCDLPLGTPIAVPAELPVAGHLAPPEERVTLLALLLGDGNTKLSGRRGTRPNAFFHSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1651 - protein, 783 aa, Artificial Sequence
  Synthetic Construct, P77853-Tth-T134-121
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHTLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSSDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1652 - protein, 783 aa, Artificial Sequence
  Synthetic Construct, P77853-Tth-T134-122
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLGAATGQRVPIEKVRPGMEVFSLGPDYRLYRVPVLEVLESGVREVVRLRTRSGRTLVLTPDHQLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1653 - protein, 783 aa, Artificial Sequence
  Synthetic Construct, P77853-Tth-T134-144
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEASRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1654 - protein, 783 aa, Artificial Sequence
  Synthetic Construct, P77853-Tth-T134-153
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHLLLTPEGWKPLCDLPLGTPIAVPAELPVAGHLAPPEERVTLLALLLGDGNTKLSGRRGTRPNAFFYGKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGRARTFDLRVPPYANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1655 - protein, 784 aa, Artificial Sequence
  Synthetic Construct, P77853-Tth-T134-167
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRQGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNNVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1656 - protein, 783 aa, Artificial Sequence
  Synthetic Construct, P77853-Tth-T134-168
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHLLLTPEGWKPLCDLPLETPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVFWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1657 - protein, 784 aa, Artificial Sequence
  Synthetic Construct, P77853-Tth-T134-173
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELHVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1658 - protein, 783 aa, Artificial Sequence
  Synthetic Construct, P77853-Tth-T134-174
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNKSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1659 - protein, 784 aa, Artificial Sequence; identical to SEQ ID NO: 1630
  Synthetic Construct, P77853-Tth-T134-175

SEQ ID NO: 1660 - protein, 784 aa, Artificial Sequence
  Synthetic Construct, P77853-Tth-T134-180
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSPMGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1661 - protein, 784 aa, Artificial Sequence
  Synthetic Construct, P77853-Tth-T134-190
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLGAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYIVSEAKRRSGFSWSEAGRRVVVAGSCLSSGLNLKLPRRYLSRHRLSLLGEAFADPGLEALAEGQVLWDPIVAVEPAGKARTFDLRVPPFANFVSEDLVVHNQRSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1662 - protein, 784 aa, Artificial Sequence; identical to SEQ ID NO: 1630
  Synthetic Construct, P77853-Tth-T134-191

SEQ ID NO: 1663 - protein, 784 aa, Artificial Sequence
  Synthetic Construct, P77853-Tth-T134-193
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGTKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1664 - protein, 784 aa, Artificial Sequence
  Synthetic Construct, P77853-Tth-T134-194
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAEIIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNNVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1665 - protein, 784 aa, Artificial Sequence
  Synthetic Construct, P77853-Tth-T134-195
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLASLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEVLAEGQVLWDPIVAVEPAGKARTFDLRVPPFANFVSEDLVVHNTSPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1666 - protein, 783 aa, Artificial Sequence
  Synthetic Construct, P77853-Tth-T134-218
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRLSEAKRRSGFSWSEAGRRVTVAGSCLSSGLNLKLPRRYLSRHRLSLLGEAFADPGLEALAEGQVLWDPIVAVEPAGKARTFDLRVPPFANFVSEDLVVHNKSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1667 - protein, 783 aa, Artificial Sequence
  Synthetic Construct, P77853-Tth-T134-219
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHLLLTPEGWEPLCDLPLGTPIAVPAELPVAGHFAPPEERVTLLALLLGDGNTKLSGRRGTRPNAFFYSKDPELLAAHRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1668 - protein, 783 aa, Artificial Sequence; identical to SEQ ID NO: 1658
  Synthetic Construct, P77853-Tth-T134-225

SEQ ID NO: 1669 - protein, 783 aa, Artificial Sequence
  Synthetic Construct, P77853-Tth-T134-238
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERATLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1670 - protein, 783 aa, Artificial Sequence
  Synthetic Construct, P77853-Tth-T134-248
MFLKKLSKLLLVVLLVAVYTQVNAQTSITLTSNASGTFDGYYYELWKDTGNTTMTVYTQGHFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGAREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAHDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1671 - protein, 783 aa, Artificial Sequence; identical to SEQ ID NO: 1636
  Synthetic Construct, P77853-Tth-T134-249

SEQ ID NO: 1672 - protein, 783 aa, Artificial Sequence
  Synthetic Construct, P77853-Tth-S158-2
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLPGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDDAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1673 - protein, 783 aa, Artificial Sequence
  Synthetic Construct, P77853-Tth-S158-4
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWNPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1674 - protein, 783 aa, Artificial Sequence
  Synthetic Construct, P77853-Tth-S158-7
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAGGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1675 - protein, 783 aa, Artificial Sequence
  Synthetic Construct, P77853-Tth-S158-19
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPIAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1676 - protein, 783 aa, Artificial Sequence
  Synthetic Construct, P77853-Tth-S158-20
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1677 - protein, 783 aa, Artificial Sequence
  Synthetic Construct, P77853-Tth-S158-21
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCGEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSQHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1678 - protein, 783 aa, Artificial Sequence
  Synthetic Construct, P77853-Tth-S158-25
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1679 - protein, 783 aa, Artificial Sequence
  Synthetic Construct, P77853-Tth-S158-38
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVSEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1680 - protein, 783 aa, Artificial Sequence
  Synthetic Construct, P77853-Tth-S158-39
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLSSTDGSVERKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGQRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1681 - protein, 783 aa, Artificial Sequence; identical to SEQ ID NO: 1679
  Synthetic Construct, P77853-Tth-S158-42

SEQ ID NO: 1682 - protein, 783 aa, Artificial Sequence
  Synthetic Construct, P77853-Tth-S158-107
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYAHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRASEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1683 - protein, 783 aa, Artificial Sequence
  Synthetic Construct, P77853-Tth-S158-111
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIIESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGISSQLRSRGPRAHEVLISGREDILQFAELIGPYLLGAKRERLAALEAEARRRLPGQGWHLRLVLPAVAYRVSQAKRRTGFSWSEAGRRVAVAGSCLSSELNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1684 - protein, 783 aa, Artificial Sequence; identical to SEQ ID NO: 1683
  Synthetic Construct, P77853-Tth-S158-112

SEQ ID NO: 1685 - protein, 783 aa, Artificial Sequence
  Synthetic Construct, P77853-Tth-S158-113
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALVLFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRRRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1686 - protein, 783 aa, Artificial Sequence
  Synthetic Construct, P77853-Tth-S158-115
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLALPAVAYRVSEAKRRSGFSWSEAGRRVAVAGSCLSSGLNLKLPRRYLSRHRLSLLGEAFADPGLEALAEGQVLWDPIVAVESAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1687 - protein, 783 aa, Artificial Sequence
  Synthetic Construct, P77853-Tth-S158-128
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPPGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVERKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVTGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1688 - protein, 783 aa, Artificial Sequence
  Synthetic Construct, P77853-Tth-S158-131
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALAIFLGRLFSTDGSVEKKRISYSSAGLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1689 - protein, 783 aa, Artificial Sequence
  Synthetic Construct, P77853-Tth-S158-132
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVSEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGPCLSSGLNLKLPRRYLSRHRLSLLGEAFADPELEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1690 - protein, 783 aa, Artificial Sequence
  Synthetic Construct, P77853-Tth-S158-137
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPRQGWHLRLVLPAVAYRVSEAKRRSGFSWSEAGRRVAVAGSCLSSGLNLKLPRRYLSRHRLSLLGEAFADPGLEALAEGQVHWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1691 - protein, 783 aa, Artificial Sequence
  Synthetic Construct, P77853-Tth-S158-138
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLGQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1692 - protein, 897 aa, Artificial Sequence
  Synthetic Construct, P77853-PspPol-S63
MFLKKLSKLLLVVLLVAVYTQVNAQTSITLTSNASGTFDGYYYELWKDTGNTTMTVYTQGRFSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1693 - protein, 897 aa, Artificial Sequence
  Synthetic Construct, P77853-PspPol-S67
MFLKKLSKLLLVVLLVAVYTQVNAQTSITLTSNASGTFDGYYYELWKDTGNTTMTVYTQGRFSCQWSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1694 - protein, 897 aa, Artificial Sequence
  Synthetic Construct, P77853-PspPol-S86
MFLKKLSKLLLVVLLVAVYTQVNAQTSITLTSNASGTFDGYYYELWKDTGNTTMTVYTQGRFSCQWSNINNALFRTGKKYNQNWQSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1695 - protein, 897 aa, Artificial Sequence
  Synthetic Construct, P77853-PspPol-S95
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1696 - protein, 897 aa, Artificial Sequence
  Synthetic Construct, P77853-PspPol-S112
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1697 - protein, 897 aa, Artificial Sequence
  Synthetic Construct, P77853-PspPol-S124
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1698 - protein, 897 aa, Artificial Sequence
  Synthetic Construct, P77853-PspPol-S178
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSILPEEWVPLIKNGKVKIFRIGDFVDGLMKANQGKVKKTGDTEVLEVAGIHAFSFDRKSKKARVMAVKAVIRHRYSGNVYRIVLNSGRKITITEGHSLFVYRNGDLVEATGEDVKIGDLLAVPRSVNLPEKRERLNIVELLLNLSPEETEDIILTIPVKGRKNFFKGMLRTLRWIFGEEKRVRTASRYLRHLENLGYIRLRKIGYDIIDKEGLEKYRTLYEKLVDVVRYNGNKREYLVEFNAVRDVISLMPEEELKEWRIGTRNGFRMGTFVDIDEDFAKLLGYYVSEGSARKWKNQTGGWSYTVRLYNENDEVLDDMEHLAKKFFGKVKRGKNYVEIPKKMAYIIFESLCGTLAENKRVPEVIFTSSKGVRWAFLEGYFIGDGDVHPSKRVRLSTKSELLVNGLVLLLNSLGVSAIKLGYDSGVYRVYVNEELKFTEYRKKKNVYHSHIVPKDILKETFGKVFQKNISYKKFRELVENGKLDREKAKRIEWLLNGDIVLDRVVEIKREYYDGYVYDLSVDEDENFLAGFGFLYAHNSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1699 - protein, 783 aa, Artificial Sequence
  Synthetic Construct, P77853-Tth-S158-30
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1700 - protein, 783 aa, Artificial Sequence
  Synthetic Construct, P77853-Tth-S158-30-38
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYKSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1701 - protein, 783 aa, Artificial Sequence
  Synthetic Construct, P77853-Tth-S158-30-103
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTARIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1702 - protein, 783 aa, Artificial Sequence
  Synthetic Construct, P77853-Tth-S158-30-108/205/345
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHKVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1703 - protein, 783 aa, Artificial Sequence
  Synthetic Construct, P77853-Tth-S158-30-133
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGRKDILRFAELIGPYLLGAKRERLAALEAEARRRLPGQGWHLRLVLPAVAYRVSEAKRRSGFSWSEAGRRVAVAGSCLSSGLNLKLPRRYLSRHRMSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1704 - protein, 783 aa, Artificial Sequence
  Synthetic Construct, P77853-Tth-S158-30-209
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHKVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTSSQGSSSGSSGGSSGSTTTTRIECENMSLSGPYVSRITSPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1705 - protein, 783 aa, Artificial Sequence
  Synthetic Construct, P77853-Tth-S158-30-217
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIVKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1706 - protein, 783 aa, Artificial Sequence
  Synthetic Construct, P77853-Tth-S158-30-218/219
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1707 - protein, 783 aa, Artificial Sequence
  Synthetic Construct, P77853-Tth-S158-30-460
MFLKKLSKLLLVVLLVAVYTQVNAQTSITLTSNASGKFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1708 - protein, 783 aa, Artificial Sequence
  Synthetic Construct, P77853-Tth-S158-m69
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVSEVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRLSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1709 - protein, 783 aa, Artificial Sequence
  Synthetic Construct, P77853-Tth-S158-m70
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVRRLVVEAGMVAKAEEKRVPEEVFRYRREALALFLGRLFSTDGSVEKKRISYSSASLGLAQDVAHLLLRLGITSQLRSRGPRAHEVLISCREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1710 - protein, 783 aa, Artificial Sequence
  Synthetic Construct, P77853-Tth-S158-m79
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPCLAEGSLVLDAATGQRVPIEKVRPGMEVFSLGPDYRLYQVPVLEVLESGVGEVVRLRTRSGRTLVLTPDHPLLTPEGWKPLCDLPLGTPIAVPAELPVAGHLAPPEERVTPLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSMLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1711 - protein, 784 aa, Artificial Sequence
  Synthetic Construct, P77853-Tth-T134-100-101
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKNPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVGEAERRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1712 - protein, 784 aa, Artificial Sequence
  Synthetic Construct, P77853-Tth-T134-100-119/157
MFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYILYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTHATLAPRPGAQDPVKRLVVEAGMVAKAEEKRVPEEVFRYRREALALFLGRLFSTDGSVEKKRISYSSASLGLAQDVAHLLPRLGITSQLRSRGPRAHEVLISGREDILRFAELIGPYLLGAKRERLAALEAEARRRLPGQGWHLRLVLPAVAYRVSEAKRRSGFLWSEAGRRAAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 1713 - protein, 546 aa, Artificial Sequence
  Synthetic Construct, P26222-mTth004-S43-1
MNDSPFYVNPNMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPDSEGNVLWDPIVAVEPAGKARTFDLRVPPFANFVSEDLVVHNSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1714 - protein, 546 aa, Artificial Sequence
  Synthetic Construct, P26222-mTth005-S43-1
MNDSPFYVNPNMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPSSDGLVLWDPIVAVEPAGKARTFDLRVPPFANFVSEDLVVHNSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1715 - protein, 546 aa, Artificial Sequence
  Synthetic Construct, P26222-mTth008-S43-1
MNDSPFYVNPNMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPQEGVGVLWDPIVAVEPAGKARTFDLRVPPFANFVSEDLVVHNSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1716 - protein, 546 aa, Artificial Sequence
  Synthetic Construct, P26222-mTth001-S115-1
MNDSPFYVNPNMSSAEWVRNNPNDPRTPVIRDRIASVPQGTWFAHHNPGQITGQVDALMSAAQAAGKIPILVVYNAPGRDCGNHCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGTDGDVLWDPIVAVEPAGKARTFDLRVPPFANFVSEDLVVHNSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1717 - protein, 546 aa, Artificial Sequence
  Synthetic Construct, P26222-mTth002-S115-1
MNDSPFYVNPNMSSAEWVRNNPNDPRTPVIRDRIASVPQGTWFAHHNPGQITGQVDALMSAAQAAGKIPILVVYNAPGRDCGNHCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPDQKVLWDPIVAVEPAGKARTFDLRVPPFANFVSEDLVVHNSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1718 - protein, 546 aa, Artificial Sequence
  Synthetic Construct, P26222-mTth004-S115-1
MNDSPFYVNPNMSSAEWVRNNPNDPRTPVIRDRIASVPQGTWFAHHNPGQITGQVDALMSAAQAAGKIPILVVYNAPGRDCGNHCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPDSEGNVLWDPIVAVEPAGKARTFDLRVPPFANFVSEDLVVHNSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1719 - protein, 546 aa, Artificial Sequence
  Synthetic Construct, P26222-mTth007-S123-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGETNGVLWDPIVAVEPAGKARTFDLRVPPFANFVSEDLVVHNSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1720 - protein, 545 aa, Artificial Sequence
  Synthetic Construct, P26222-mTth002-S154-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPDQKVLWDPIVAVEPAGKARTFDLRVPPFANFVSEDLVVHNSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAAMLTFRRQVRLARRATSGIMVLSPRAPAQSLALSAQREIQIASPLSRAPP

SEQ ID NO: 1721 - protein, 546 aa, Artificial Sequence
  Synthetic Construct, P26222-mTth003-S154-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPEPGKGVLWDPIVAVEPAGKARTFDLRVPPFANFVSEDLVVHNSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1722 - protein, 546 aa, Artificial Sequence
  Synthetic Construct, P26222-mTth004-S154-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPDSEGNVLWDPIVAVEPAGKARTFDLRVPPFANFVSEDLVVHNSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1723 - protein, 546 aa, Artificial Sequence
  Synthetic Construct, P26222-mTth005-S154-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPSSDGLVLWDPIVAVEPAGKARTFDLRVPPFANFVSEDLVVHNSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1724 - protein, 546 aa, Artificial Sequence
  Synthetic Construct, P26222-mTth008-S154-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPQEGVGVLWDPIVAVEPAGKARTFDLRVPPFANFVSEDLVVHNSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1725 - protein, 546 aa, Artificial Sequence
  Synthetic Construct, P26222-mTth007-S220-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGETNGVLWDPIVAVEPAGKARTFDLRVPPFANFVSEDLVVHNSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1726 - protein, 546 aa, Artificial Sequence
  Synthetic Construct, P26222-mTth001-S251-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGTDGDVLWDPIVAVEPAGKARTFDLRVPPFANFVSEDLVVHNSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1727 - protein, 546 aa, Artificial Sequence
  Synthetic Construct, P26222-mTth002-S251-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPDQKVLWDPIVAVEPAGKARTFDLRVPPFANFVSEDLVVHNSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1728 - protein, 546 aa, Artificial Sequence
  Synthetic Construct, P26222-mTth005-S251-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPSSDGLVLWDPIVAVEPAGKARTFDLRVPPFANFVSEDLVVHNSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1729 - protein, 546 aa, Artificial Sequence
  Synthetic Construct, P26222-mTth007-S251-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGETNGVLWDPIVAVEPAGKARTFDLRVPPFANFVSEDLVVHNSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1730 - protein, 546 aa, Artificial Sequence
  Synthetic Construct, P26222-mTth008-S251-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPQEGVGVLWDPIVAVEPAGKARTFDLRVPPFANFVSEDLVVHNSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1731 - protein, 547 aa, Artificial Sequence
  Synthetic Construct, P26222-mTth010-S251-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLQTMAYAGKALKAGSSQARIYFDAGHSAWHSPAQMASWLQQADISNSAHGIATNTSNYRWTADEVAYAKAVLSAIGNPSLRAVIDTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNALNADVSTSGSSVTARNVGHNGTLSQGASTEFGFVGSKGNSNSVPTLTCAAS

SEQ ID NO: 1732 - protein, 546 aa, Artificial Sequence
  Synthetic Construct, P26222-mTth002-S123-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPDQKVLWDPIVAVEPAGKARTFDLRVPPFANFVSEDLVVHNSAYRSWIDEFAAGLKNRPAYIIVEPDLISLMSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 1733 - protein, 547 aa, Artificial Sequence
  Synthetic Construct, P26222-mTth010-S115-1
MNDSPFYVNPNMSSAEWVRNNPNDPRTPVIRDRIASVPQGTWFAHHNPGQITGQVDALMSAAQAAGKIPILVVYNAPGRDCGNHCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSSGGAPSHSAYRSWIDEFAAGLKNRPAYIIVEPDLISLMSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 1734 - protein, 547 aa, Artificial Sequence
  Synthetic Construct, P26222-mTth010-S154-1
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 1735 - protein, 547 aa, Artificial Sequence
  Synthetic Construct, P26222-mTth010-S154-2
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLSTRSGRTLVLTPNHPLLTPEGWKPLCDLPLGTPIAVRDVETGEVLWDPIVAVEPAGKARTFDLRVPPFANFVSEDLVVHNSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 1736 - protein, 547 aa, Artificial Sequence
  Synthetic Construct, P26222-mTth010-S154-3
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVMEVLESGVREVVRLRTRSGRTLVLTPDHPLLTPEGWKPLCDLPLGTPIAVRDVETGEVLWDPIVAVEPAGKARTFDLRVPPFANFVSEDLVVHNSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 1737 - protein, 547 aa, Artificial Sequence
  Synthetic Construct, P26222-mTth010-S154-4
MNDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMCLAEGSLVLDAATGQRVPIEKVRPGMEVFSLGPDYRLYRVPVLEVLESGVREVVRLRTRSGRTLVLTANHPLLTPEGWKPLCDLPLGTPIAVRDVETGEVLWDPIVAVEPAGKARTFDLRVPPFANFVSEDLVVHNSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 1738 - protein, 547 aa, Artificial Sequence; identical to SEQ ID NO: 1737
  Synthetic Construct, P26222-mTth010-S154-5

SEQ ID NO: 1739 - protein, 945 aa, Artificial Sequence
  Synthetic Construct, P54583-Tth-S56-1
MAGGGYWHTSGREILDANNVPVRIAGINWFGFETCNYVVHGLWSRDYRSMLDQIKCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1740 - protein, 658 aa, Artificial Sequence
  Synthetic Construct, P54583-mTth010-S56-1
MAGGGYWHTSGREILDANNVPVRIAGINWFGFETCNYVVHGLWSRDYRSMLDQIKCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1741 - protein, 945 aa, Artificial Sequence
  Synthetic Construct, P54583-Tth-C75-1
MAGGGYWHTSGREILDANNVPVRIAGINWFGFETCLAEGTRVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEGVVVHNCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1742 - protein, 945 aa, Artificial Sequence
  Synthetic Construct, P54583-Tth-S192-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1743 - protein, 945 aa, Artificial Sequence
  Synthetic Construct, P54583-Tth-S237-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1744 - protein, 658 aa, Artificial Sequence
  Synthetic Construct, P54583-mTth010-S237-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1745 - protein, 658 aa, Artificial Sequence
  Synthetic Construct, P54583-mTth010-S56-2
MAGGGYWHTSGREILDANNVPVRIAGINWFGFETCNYVVHGLWSRDYRSMLDQIKCLAEGSLVLDAATGQRVPIEKVRPGMEVFSLGPDYRLYRVPVLEVLESGVREVVRLRTRSGRTLVSTPDHPLLTPEGWKPLCDLPLGTPIAVRDVETGEVLWDPIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1746 - protein, 658 aa, Artificial Sequence
  Synthetic Construct, P54583-mTth010-S56-3
MAGGGYWHTSGREILDANNVPVRIAGINWFGFETCNYVVHGLWSRDYRSMLDQIKCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDLIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1747 - protein, 658 aa, Artificial Sequence
  Synthetic Construct, P54583-mTth010-S56-4
MAGGGYWHTSGREILDANNVPVRIAGINWFGFETCNYVVHGLWSRDYRSMLDQIKCLAEGSLVLDAATGQRVPIEKVRPGMEVFSLGPDYRLYRVPVLEVLESGVREVVCLRTRSGRTLVLTPDHPLLTPEGWKPLCDLPLGTPIAVRDVETGEVLWDPIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1748 - protein, 658 aa, Artificial Sequence; identical to SEQ ID NO: 1747
  Synthetic Construct, P54583-mTth010-S56-5

SEQ ID NO: 1749 - protein, 658 aa, Artificial Sequence
  Synthetic Construct, P54583-mTth010-S56-6
MAGGGYWHTSGREILDANNVSVRIAGINWFGFETCNYVVHGLWSRDYRSMLDQIKCLAEGSLVLDAATGQRVPIEKVRPGMKVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1750 - protein, 658 aa, Artificial Sequence
  Synthetic Construct, P54583-mTth010-S56-7
MAGGGYWHTSGREILDANNVPVRIAGINWFGFETCNYVVHGLWSRDYRSMLDQIKCLAEGSLVLDAATGQRVPIEKVRPGMEVFSLGPDYRLYRVPVLEVLESGVREVVRLRTRSGRTLVLTPDHPLLTPEGWKPLCDLPVGTPIAVRDVETGEVLWDPIVAVEPAGKARTFDLRVPPFANFVSEDLVVHNSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1751 - protein, 658 aa, Artificial Sequence
  Synthetic Construct, P54583-mTth010-S237-2
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLAPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1752 - protein, 658 aa, Artificial Sequence
  Synthetic Construct, P54583-mTth010-S237-3
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLSPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1753 - protein, 945 aa, Artificial Sequence
  Synthetic Construct, P54583-Tth-T154-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1754 - protein, 945 aa, Artificial Sequence
  Synthetic Construct, P54583-Tth-S135-1
MAGGGYWHTSGREILDANNVPVRIAGINWFGFETCNYVVHGLWSRDYRSMLDQIKSLGYNTIRLPYSDDILKPGTMPNSINFYQMNQDLQGLTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1755 - protein, 945 aa, Artificial Sequence
  Synthetic Construct, P54583-Tth-S134-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1756 - protein, 945 aa, Artificial Sequence; identical to SEQ ID NO: 1739
  Synthetic Construct, P54583-Tth-S96-1

SEQ ID NO: 1757 - protein, 945 aa, Artificial Sequence; identical to SEQ ID NO: 1754
  Synthetic Construct, P54583-Tth-S94-1

SEQ ID NO: 1758 - protein, 945 aa, Artificial Sequence
  Synthetic Construct, P54583-Tth-T93-1
MAGGGYWHTSGREILDANNVPVRIAGINWFGFETCNYVVHGLWSRDYRSMLDQIKSLGYNTIRLPYSDDILKPGTMPNSINFYQMNQDLQGLCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1759 - protein, 945 aa, Artificial Sequence
  Synthetic Construct, P54583-Tth-S67-1
MAGGGYWHTSGREILDANNVPVRIAGINWFGFETCNYVVHGLWSRDYRSMLDQIKSLGYNTIRLPYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1760 - protein, 945 aa, Artificial Sequence
  Synthetic Construct, P54583-Tth-T61-1
MAGGGYWHTSGREILDANNVPVRIAGINWFGFETCNYVVHGLWSRDYRSMLDQIKSLGYNCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1761 - protein, 945 aa, Artificial Sequence
  Synthetic Construct, P54583-Tth-S10-1
MAGGGYWHTCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1762 - protein, 945 aa, Artificial Sequence
  Synthetic Construct, P54583-Tth-S393-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1763 - protein, 945 aa, Artificial Sequence; identical to SEQ ID NO: 1762
  Synthetic Construct, P54583-Tth-S353-1

SEQ ID NO: 1764 - protein, 945 aa, Artificial Sequence
  Synthetic Construct, P54583-Tth-S330-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1765 - protein, 945 aa, Artificial Sequence
  Synthetic Construct, P54583-Tth-S321-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1766 - protein, 945 aa, Artificial Sequence
  Synthetic Construct, P54583-Tth-S314-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1767 - protein, 945 aa, Artificial Sequence; identical to SEQ ID NO: 1743
  Synthetic Construct, P54583-Tth-S277-1

SEQ ID NO: 1768 - protein, 945 aa, Artificial Sequence; identical to SEQ ID NO: 1764
  Synthetic Construct, P54583-Tth-S290-1

SEQ ID NO: 1769 - protein, 945 aa, Artificial Sequence
  Synthetic Construct, P54583-Tth-C465-1
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 1770 - protein, 856 aa, Artificial Sequence
  Synthetic Construct, O77044-Tth-S84-1
SAYDYKQVLRDSLLFYEAQRSGRLPADQKVTWRKDSALNDQGDQGQDLTGGYFDAGDFVKFGFPMAYTATVLAWGLIDFEAGYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 1771 - protein, 856 aa, Artificial Sequence
  Synthetic Construct, O77044-Tth-T303-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 1772 - protein, 856 aa, Artificial Sequence
  Synthetic Construct, O77044-Tth-S325-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 1773 - protein, 856 aa, Artificial Sequence
  Synthetic Construct, O77044-Tth-T333-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 1774 - protein, 856 aa, Artificial Sequence
  Synthetic Construct, O77044-Tth-S345-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 1775 - protein, 856 aa, Artificial Sequence
  Synthetic Construct, O77044-Tth-C348-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 1776 - protein, 856 aa, Artificial Sequence
  Synthetic Construct, O77044-Tth-S352-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSNPPTRPHHRSSSCPPAPATCDWNTFNSPDPNYHVLSGALVGGPDQNDNYVDDRSDYVHNEVATDYNAGFQSALAALVALGY

SEQ ID NO: 1777 - protein, 856 aa, Artificial Sequence
  Synthetic Construct, O77044-Tth-T356-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTRPHHRSSSCPPAPATCDWNTFNSPDPNYHVLSGALVGGPDQNDNYVDDRSDYVHNEVATDYNAGFQSALAALVALGY

SEQ ID NO: 1778 - protein, 856 aa, Artificial Sequence
  Synthetic Construct, O77044-Tth-S362-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSSSCPPAPATCDWNTFNSPDPNYHVLSGALVGGPDQNDNYVDDRSDYVHNEVATDYNAGFQSALAALVALGY

SEQ ID NO: 1779 - protein, 856 aa, Artificial Sequence
  Synthetic Construct, O77044-Tth-S363-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSSCPPAPATCDWNTFNSPDPNYHVLSGALVGGPDQNDNYVDDRSDYVHNEVATDYNAGFQSALAALVALGY

SEQ ID NO: 1780 - protein, 856 aa, Artificial Sequence
  Synthetic Construct, O77044-Tth-S364-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSCPPAPATCDWNTFNSPDPNYHVLSGALVGGPDQNDNYVDDRSDYVHNEVATDYNAGFQSALAALVALGY

SEQ ID NO: 1781 - protein, 856 aa, Artificial Sequence
  Synthetic Construct, O77044-Tth-T376-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTFNSPDPNYHVLSGALVGGPDQNDNYVDDRSDYVHNEVATDYNAGFQSALAALVALGY

SEQ ID NO: 1782 - protein, 856 aa, Artificial Sequence
  Synthetic Construct, O77044-Tth-S379-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSPDPNYHVLSGALVGGPDQNDNYVDDRSDYVHNEVATDYNAGFQSALAALVALGY

SEQ ID NO: 1783 - protein, 856 aa, Artificial Sequence
  Synthetic Construct, O77044-Tth-S406-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSDYVHNEVATDYNAGFQSALAALVALGY

SEQ ID NO: 1784 - protein, 856 aa, Artificial Sequence
  Synthetic Construct, O77044-Tth-T415-1
SAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTDYNAGFQSALAALVALGY

SEQ ID NO: 1785 - DNA, 2352 bp, Artificial Sequence
  Synthetic Construct, P77853-Tth-T134-1 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgtgccacttggccccacctgaagaacgtgttacgctcctggctcttctgttgggggatgggaacacaaagccgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccttgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1786 - DNA, 2352 bp, Artificial Sequence
  Synthetic Construct, P77853-Tth-T134-2 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctcattgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1787 - DNA, 2352 bp, Artificial Sequence
  Synthetic Construct, P77853-Tth-T134-3 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcttggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagcgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1788 - DNA, 2352 bp, Artificial Sequence
  Synthetic Construct, P77853-Tth-T134-9 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacatccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgataccggcgtgaggcgttggccctttacttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggctgtcgctgctcggtgaggcttttgccgaccctgggctggaagcgctcgcggaaggccaagtgctctgggaccctattgttgctgtcgaaccggccggtaaggcgagaacatttgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1789 - DNA, 2349 bp, Artificial Sequence
  Synthetic Construct, P77853-Tth-T134-12 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacatactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaagtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1790 - DNA, 2352 bp, Artificial Sequence
  Synthetic Construct, P77853-Tth-T134-36 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggcacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1791 - DNA, 2341 bp, Artificial Sequence
  Synthetic Construct, P77853-Tth-T134-42 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgactacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacc

SEQ ID NO: 1792 - DNA, 2349 bp, Artificial Sequence
  Synthetic Construct, P77853-Tth-T134-43 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacctgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1793 - DNA, 2349 bp, Artificial Sequence
  Synthetic Construct, P77853-Tth-T134-45 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgtgtgcccgttttggaggtccttgagagcggggttagggaagttgtgcgcctcagaactcggtcagggagaacgctggtgttgacaccagatcacctgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1794 - DNA, 2352 bp, Artificial Sequence
  Synthetic Construct, P77853-Tth-T134-48 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtctcggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgccacgttgtcgaggcgggaatggttgctaaagccgaagagaagagggtcccggaggaggtgtttcgttaccggcgtgaggcgttggccctttccttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgtccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccttgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1795 - DNA, 2349 bp, Artificial Sequence
  Synthetic Construct, P77853-Tth-T134-49 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtacgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctattgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacagtcccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1796 - DNA, 2349 bp, Artificial Sequence
  Synthetic Construct, P77853-Tth-T134-80 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtggtacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1797 - DNA, 2352 bp, Artificial Sequence
  Synthetic Construct, P77853-Tth-T134-82 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccttgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1798 - DNA, 2352 bp, Artificial Sequence
  Synthetic Construct, P77853-Tth-T134-83 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggagcctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccttgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1799 - DNA, 2352 bp, Artificial Sequence
  Synthetic Construct, P77853-Tth-T134-89 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggctacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaaactgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1800 - DNA, 2349 bp, Artificial Sequence
  Synthetic Construct, P77853-Tth-T134-91 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccactttggggctggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaagtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1801 - DNA, 2349 bp, Artificial Sequence
  Synthetic Construct, P77853-Tth-T134-95 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgcctccttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattagatctcaactccgttcgagagggccacgggctcacgaggttcttatatcgggccgcgaggatattttgcgatttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaagtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1802 - DNA, 2349 bp, Artificial Sequence
  Synthetic Construct, P77853-Tth-T134-98 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgtttcggaggtccttgagagcggggttagggaagttgtgcgcctcagaactcggtcagggagaacgctggtgttgacaccagatcacctgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1803 - DNA, 2352 bp, Artificial Sequence
  Synthetic Construct, P77853-Tth-T134-100 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1804 - DNA, 2352 bp, Artificial Sequence
  Synthetic Construct, P77853-Tth-T134-108 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaagtgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagcctcgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgatagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccggtcccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1805 - DNA, 2352 bp, Artificial Sequence
  Synthetic Construct, P77853-Tth-T134-110 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcctcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1806 - DNA, 2349 bp, Artificial Sequence
  Synthetic Construct, P77853-Tth-T134-119 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacacgcttttgacacccgaaggttggaaacccctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttccacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1807 - DNA, 2349 bp, Artificial Sequence
  Synthetic Construct, P77853-Tth-T134-121 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacacgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgtcagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccttggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1808 - DNA, 2349 bp, Artificial Sequence
  Synthetic Construct, P77853-Tth-T134-122 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttgggcgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcaccagcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaacccttgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1809 - DNA, 2349 bp, Artificial Sequence
  Synthetic Construct, P77853-Tth-T134-144 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggccagcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacagtcccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1810 - DNA, 2349 bp, Artificial Sequence
  Synthetic Construct, P77853-Tth-T134-153 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacctgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacggcaaagaccccgaattgctcgcggcttatcgccggtgtgcagaagccttgggtgcaaaggtgaaagcatacgtccacccgaccacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccgcgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgttacctttctcggcaccggttgtcgctgctcggtgaggcttttgccgaccctgggctggaagcgctcgcggaaggccaagtgctctgggaccctattgttgctgtcgaaccggccggtagggcgagaacattcgacttgcgcgttccaccctatgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1811 - DNA, 2352 bp, Artificial Sequence
  Synthetic Construct, P77853-Tth-T134-167 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtcaggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaagaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaacgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1812 - DNA, 2349 bp, Artificial Sequence
  Synthetic Construct, P77853-Tth-T134-168 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacctgcttttgacccccgaaggttggaaacctctttgtgacctcccgcttgaaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgttctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1813 - DNA, 2352 bp, Artificial Sequence
  Synthetic Construct, P77853-Tth-T134-173 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcatgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaagcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1814 - DNA, 2349 bp, Artificial Sequence
  Synthetic Construct, P77853-Tth-T134-174 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaagtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1815 - DNA, 2352 bp, Artificial Sequence
  Synthetic Construct, P77853-Tth-T134-175 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1816 - DNA, 2352 bp, Artificial Sequence
  Synthetic Construct, P77853-Tth-T134-180 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccatgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1817 - DNA, 2352 bp, Artificial Sequence
  Synthetic Construct, P77853-Tth-T134-190 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttgggcgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacatagtgagcgaggctaaaaggcgctcgggattttcgtggagtgaagccggtcggcgcgtcgtagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgtcgctgtcgaaccggccggtaaggcgagaacattcgacttgcgcgttccaccctttgcaaacttcgtgagcgaggacctggtggtgcataaccaacgttccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1818 - DNA, 2352 bp, Artificial Sequence
  Synthetic Construct, P77853-Tth-T134-191 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgttcacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcacttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1819 - DNA, 2352 bp, Artificial Sequence
  Synthetic Construct, P77853-Tth-T134-193 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttagaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtacaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacggtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1820 - DNA, 2352 bp, Artificial Sequence
  Synthetic Construct, P77853-Tth-T134-194 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccgacgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaaattatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaacgttcccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1821 - DNA, 2352 bp, Artificial Sequence
  Synthetic Construct, P77853-Tth-T134-195 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcatccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagtgctcgcggaaggccaagtgctctgggaccctattgttgctgtcgaaccggccggtaaggcgagaacattcgacttgcgcgttccaccctttgcaaacttcgtgagcgaggacctggtggtgcataacacgtcccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1822 - DNA, 2349 bp, Artificial Sequence
  Synthetic Construct, P77853-Tth-T134-218 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcaggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagattgagcgaggctaaaaggcgctcgggattttcgtggagtgaagccggtcggcgcgtcacagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaagtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1823 - DNA, 2349 bp, Artificial Sequence
  Synthetic Construct, P77853-Tth-T134-219 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacctgcttttgacccccgaaggttgggaacctctttgtgacctcccgcttggaactccaattgcagtccccgcagaactgcctgtagcgggccactttgccccacctgaagaacgtgttacgctcctggctcttctgttgggggatgggaacacaaagctgtcgggtcggagaggtacacgtcctaatgccttcttctacagcaaagaccccgaattgctcgcggctcatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1824 - DNA, 2349 bp, Artificial Sequence; identical to SEQ ID NO: 1814
  Synthetic Construct, P77853-Tth-T134-225 DNA

SEQ ID NO: 1825 - DNA, 2349 bp, Artificial Sequence
  Synthetic Construct, P77853-Tth-T134-238 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgctacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1826 - DNA, 2349 bp, Artificial Sequence
  Synthetic Construct, P77853-Tth-T134-248 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcacttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggctagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccatgatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggatcctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1827 - DNA, 2349 bp, Artificial Sequence
  Synthetic Construct, P77853-Tth-T134-249 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacctgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgctgcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1828 - DNA, 2349 bp, Artificial Sequence
  Synthetic Construct, P77853-Tth-S158-2 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgccgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgacgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1829 - DNA, 2349 bp, Artificial Sequence
  Synthetic Construct, P77853-Tth-S158-4 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctggaaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1830 - DNA, 2349 bp, Artificial Sequence
  Synthetic Construct, P77853-Tth-S158-7 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggacttaacctcaaattgcccagacgctacctttctcggcaccggttgtcgctgctcggtgaggcttttgccgaccctgggctggaagcgctcgcgggaggccaagtgctctgggaccctattgttgctgtcgaaccggccggtaaggcgagaacattcgacttgcgcgtaccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1831 - DNA, 2349 bp, Artificial Sequence
  Synthetic Construct, P77853-Tth-S158-19 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctattgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1832 - DNA, 2349 bp, Artificial Sequence
  Synthetic Construct, P77853-Tth-S158-20 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccaggcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1833 - DNA, 2349 bp, Artificial Sequence
  Synthetic Construct, P77853-Tth-S158-21 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtggagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcagcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1834 - DNA, 2349 bp, Artificial Sequence
  Synthetic Construct, P77853-Tth-S158-25 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1835 - DNA, 2349 bp, Artificial Sequence
  Synthetic Construct, P77853-Tth-S158-38 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagtgaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1836 - DNA, 2349 bp, Artificial Sequence
  Synthetic Construct, P77853-Tth-S158-39 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgtcctcgacagacggctctgttgaaaggaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcagcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1837 - DNA, 2349 bp, Artificial Sequence
  Synthetic Construct, P77853-Tth-S158-42 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagtgaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctctacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1838 - DNA, 2352 bp, Artificial Sequence
  Synthetic Construct, P77853-Tth-S158-107 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgcccacccgactacgggggtggttacactcgcaaccctcgctccacgtcctggagctcaagatcctgtcaaacgcctcgttgtcgaggcggggatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgccgaacttatcggaccctacctcttgggggccaagagggagagacttgcagcgctggaagctgaggcccgcaggcgtttgcctggacagggatggcacttgcggcttgttcttcctgccgtggcgtacagagcgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1839 - DNA, 2352 bp, Artificial Sequence
  Synthetic Construct, P77853-Tth-S158-111 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacattattgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgctaggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaatttcatctcaactccgttcgagagggccacgggctcacgaggttcttatatcgggccgcgaggatattttgcagtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagccaggctaaaaggcgcacgggattttcgtggagtgaagccggtcggcgcgtcgcagttgcgggatcgtgtttgtcatctgaactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1840 - DNA, 2352 bp, Artificial Sequence; identical to SEQ ID NO: 1839
  Synthetic Construct, P77853-Tth-S158-112 DNA

SEQ ID NO: 1841 - DNA, 2352 bp, Artificial Sequence
  Synthetic Construct, P77853-Tth-S158-113 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggtccttttcttgggccgtttgttctcgacagacggctctgttgaaaagaagaggatctcttattcgagtgccagtttgggactggcccaggatgtcgcacatctcttgctgcgccttggaattacatctcaactccgttcgagaggaccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcgccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1842 - DNA, 2352 bp, Artificial Sequence
  Synthetic Construct, P77853-Tth-S158-115 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtagaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggtcgcgaggatattttgcggtttgctgaacttatcggaccctacctcttgggggccaagagggagagacttgcagcgctggaagctgaggcccgcaggcgtttgcctggacagggatggcacttgcggcttgctcttcctgccgtggcgtacagagtgagcgaggctaaaaggcgctcgggattttcgtggagtgaagccggtcggcgcgtcgcagttgcgggatcgtgtttgtcatctggactcaacctcaaattgcccaggcgctacctttctcggcaccggttgtcgctgctcggtgaggcttttgccgaccctgggctggaagcgctcgcggaaggccaagtgctatgggaccctattgttgctgtcgaatcggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaatcacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1843 - DNA, 2352 bp, Artificial Sequence
  Synthetic Construct, P77853-Tth-S158-128 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcctggaactccaattgcagtccccgcagaactgcctgtggcgggccacttggccccacctgaggaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgccaaagccgaagagaagagggtcccggaggaggtgtttcgttaccggcgtgaggcgttggcccttttcttgggccgtttgttctcgacagacggctctgttgaaaggaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgccgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttacgggatcgtgtttgtcatctggactcaacctcaaattgcccagacgctacctttctcggcaccggttgtcgctgctcggtgaggcttttgcagaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1844 - DNA, 2352 bp, Artificial Sequence
  Synthetic Construct, P77853-Tth-S158-131 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggccattttcttgggccgtttgttctcgacagacggctctgttgaaaagaagaggatctcttattcaagtgccggtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1845 - DNA, 2352 bp, Artificial Sequence
  Synthetic Construct, P77853-Tth-S158-132 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagtgaagttgtgcgcctcagaactcggtcagggagaacgctggtgttgacaccagatcacccgcttttgacccccgaaggttggaaacccctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggaccgtgtttgtcatctggactcaacctcaaattgcccagacgctacctttctcggcaccggttgtcgctgctcggtgaggcttttgccgaccctgagctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1846 - DNA, 2352 bp, Artificial Sequence
  Synthetic Construct, P77853-Tth-S158-137 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggagtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctagacagggatggcacttgcggcttgttcttcctgccgtggcgtacagagtgagcgaggctaaaaggcgatcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgcactgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1847 - DNA, 2352 bp, Artificial Sequence
  Synthetic Construct, P77853-Tth-S158-138 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgacctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactgggccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1848 - DNA, 2694 bp, Artificial Sequence
  Synthetic Construct, P77853-Tth-S63 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgctttagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1849 - DNA, 2694 bp, Artificial Sequence
  Synthetic Construct, P77853-Tth-S67 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1850 - DNA, 2694 bp, Artificial Sequence
  Synthetic Construct, P77853-Tth-S86 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1851 - DNA, 2694 bp, Artificial Sequence
  Synthetic Construct, P77853-Tth-S95 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtacagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1852 - DNA, 2694 bp, Artificial Sequence
  Synthetic Construct, P77853-Tth-S112 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1853 - DNA, 2694 bp, Artificial Sequence
  Synthetic Construct, P77853-Tth-S124 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1854 - DNA, 2694 bp, Artificial Sequence
  Synthetic Construct, P77853-Tth-S178 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggactagcattttaccggaagaatgggttccactaattaaaaacggtaaagttaagatattccgcattggggacttcgttgatggacttatgaaggcgaaccaaggaaaagtgaagaaaacgggggatacagaagttttagaagttgcaggaatccatgcgttttcctttgacaggaagtccaagaaggcccgtgtaatggcagtgaaagccgtgataagacaccgttattccggaaatgtttatagaatagtcttaaactctggtagaaaaataacaataacagaagggcatagcctatttgtctataggaacggggatctcgttgaggcaactggggaggatgtcaaaattggggatcttcttgcagttccaagatcagtaaacctaccagagaaaagggaacgcttgaatattgttgaacttcttctgaatctctcaccggaagagacagaagatataatacttacgattccagttaaaggcagaaagaacttcttcaagggaatgttgagaacattacgttggatttttggtgaggaaaagagagtaaggacagcgagccgctatctaagacaccttgaaaatctcggatacataaggttgaggaaaattggatacgacatcattgataaggaggggcttgagaaatatagaacgttgtacgagaaacttgttgatgttgtccgctataatggcaacaagagagagtatttagttgaatttaatgctgtccgggacgttatctcactaatgccagaggaagaactgaaggaatggcgtattggaactagaaatggattcagaatgggtacgttcgtagatattgatgaagattttgccaagcttcttggctactatgtgagcgagggaagtgcgaggaagtggaagaatcaaactggaggttggagttacactgtgagattgtacaacgagaacgatgaagttcttgacgacatggaacacttagccaagaagttttttgggaaagtcaaacgtggaaagaactatgttgagataccaaagaaaatggcttatatcatctttgagagcctttgtgggactttggcagaaaacaaaagggttcctgaggtaatctttacctcatcaaagggcgttagatgggccttccttgagggttatttcatcggcgatggcgatgttcacccaagcaagagggttcgcctatcaacgaagagcgagcttttagtaaatggccttgttctcctacttaactcccttggagtatctgccattaagcttggatacgatagcggagtctacagggtttatgtaaacgaggaacttaagtttacggaatacagaaagaaaaagaatgtatatcactctcacattgttccaaaggatattctcaaagaaacttttggtaaggtcttccagaaaaatataagttacaagaaatttagagagcttgtagaaaatggaaaacttgacagggagaaagccaaacgcattgagtggttacttaacggagatatagtcctagatagagtcgtagagattaagagagagtactatgatggttacgtttacgatctaagtgtcgatgaagatgagaatttccttgctggctttggattcctctatgcacataattcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1855 - DNA, 2349 bp, Artificial Sequence
  Synthetic Construct, P77853-Tth-S158-30 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1856 - DNA, 2349 bp, Artificial Sequence
  Synthetic Construct, P77853-Tth-S158-30-38 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttacaaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacgtacccctgggaggccccaattgacaatgtttatgtcagtgcggggagtcatacagtcgaaatcactgttactgcggataacggcacatgggacgtgtatgccgactacctggtgatacag

SEQ ID NO: 1857 - DNA, 2349 bp, Artificial Sequence
  Synthetic Construct, P77853-Tth-S158-30-103 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactgctcgcatcgagtgtgagaacatgtccttgtccggtccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1858 - DNA, 2349 bp, Artificial Sequence
  Synthetic Construct, P77853-Tth-S158-30-108/205/345 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1859 - DNA, 2349 bp, Artificial Sequence
  Synthetic Construct, P77853-Tth-S158-30-133 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcaaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggatgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1860 - DNA, 2349 bp, Artificial Sequence
  Synthetic Construct, P77853-Tth-S158-30-209 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacacctcctctcagggctcttcttccggcagttcgggtggctcatccggctccacaacgactactcgcatcgagtgtgagaacatgtccttgtccggaccctacgttagcaggatcaccagtccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1861 - DNA, 2349 bp, Artificial Sequence
  Synthetic Construct, P77853-Tth-S158-30-217 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgtaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttatcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacactgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1862 - DNA, 2349 bp, Artificial Sequence
  Synthetic Construct, P77853-Tth-S158-30-218/219 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1863 - DNA, 2349 bp, Artificial Sequence
  Synthetic Construct, P77853-Tth-S158-30-460 DNA
atgttccttaagaaactgtctaagttgctgctcgtcgtgctccttgttgccgtttacacacaggtcaacgcgcaaacaagcattactctgacatccaacgcatccggtaagtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1864 - DNA, 2349 bp, Artificial Sequence
  Synthetic Construct, P77853-Tth-S158-30-m69 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagtgaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggctctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1865 - DNA, 2349 bp, Artificial Sequence
  Synthetic Construct, P77853-Tth-S158-m70 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcagacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgtgccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1866 - DNA, 2349 bp, Artificial Sequence
  Synthetic Construct, P77853-Tth-S158-m79 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcaggtgcccgttttggaggtccttgagagcggggttggggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgcccctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgatgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacag

SEQ ID NO: 1867 - DNA, 2355 bp, Artificial Sequence
  Synthetic Construct, P77853-Tth-T134-100-101 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggcggaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1868 - DNA, 2355 bp, Artificial Sequence
  Synthetic Construct, P77853-Tth-T134-100-119/157 DNA
atgttccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacatactgtatcgggtgcccgttttggaggtccttgagagcggggtcagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaaactgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacacacgcaaccctagctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgccgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggatttttgtggagtgaagccggtcggcgcgccgcagttgcgggatcgtgcttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 1869 - DNA, 1641 bp, Artificial Sequence
  Synthetic Construct, P26222-mTth004-S43-1 DNA
atgaacgatagtccattctacgtgaacccgaatatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccagatagcgagggaaacgttctctgggaccctattgttgctgtcgaaccggccggtaaggcgagaacattcgacttgcgcgttccaccctttgcaaacttcgtgagcgaggacctggtggtgcataactcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1870 - DNA, 1641 bp, Artificial Sequence
  Synthetic Construct, P26222-mTth005-S43-1 DNA
atgaacgatagtccattctacgtgaacccgaatatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaagcagcgatggacttgttctctgggaccctattgttgctgtcgaaccggccggtaaggcgagaacattcgacttgcgcgttccaccctttgcaaacttcgtgagcgaggacctggtggtgcataactcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1871 - DNA, 1641 bp, Artificial Sequence
  Synthetic Construct, P26222-mTth008-S43-1 DNA
atgaacgatagtccattctacgtgaacccgaatatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccacaggagggagttggagttctctgggaccctattgttgctgtcgaaccggccggtaaggcgagaacattcgacttgcgcgttccaccctttgcaaacttcgtgagcgaggacctggtggtgcataactcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1872 - DNA, 1638 bp, Artificial Sequence
  Synthetic Construct, P26222-mTth001-S115-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggaactgatggagatgttctctgggaccctattgttgctgtcgaaccggccggtaaggcgagaacattcgacttgcgcgttccaccctttgcaaacttcgtgagcgaggacctggtggtgcataacagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcg

SEQ ID NO: 1873 - DNA, 1638 bp, Artificial Sequence
  Synthetic Construct, P26222-mTth002-S115-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggaccagatcagaaggttctctgggaccctattgttgctgtcgaaccggccggtaaggcgagaacattcgacttgcgcgttccaccctttgcaaacttcgtgagcgaggacctggtggtgcataacagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcg

SEQ ID NO: 1874 - DNA, 1638 bp, Artificial Sequence
  Synthetic Construct, P26222-mTth004-S115-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccagatagcgagggaaacgttctctgggaccctattgttgctgtcgaaccggccggtaaggcgagaacattcgacttgcgcgttccaccctttgcaaacttcgtgagcgaggacctggtggtgcataacagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcg

SEQ ID NO: 1875 - DNA, 1641 bp, Artificial Sequence
  Synthetic Construct, P26222-mTth007-S123-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggagagactaacggagttctctgggaccctattgttgctgtcgaaccggccggtaaggcgagaacattcgacttgcgcgttccaccctttgcaaacttcgtgagcgaggacctggtggtgcataacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1876 - DNA, 1637 bp, Artificial Sequence
  Synthetic Construct, P26222-mTth002-S154-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggaccagatcagaaggttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcg

SEQ ID NO: 1877 - DNA, 1641 bp, Artificial Sequence
  Synthetic Construct, P26222-mTth003-S154-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccagagccaggaaagggagttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1878 - DNA, 1641 bp, Artificial Sequence
  Synthetic Construct, P26222-mTth004-S154-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccagatagcgagggaaacgttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1879 - DNA, 1641 bp, Artificial Sequence
  Synthetic Construct, P26222-mTth005-S154-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaagcagcgatggacttgttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1880 - DNA, 1638 bp, Artificial Sequence
  Synthetic Construct, P26222-mTth008-S154-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccacaggagggagttggagttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcg

SEQ ID NO: 1881 - DNA, 1641 bp, Artificial Sequence
  Synthetic Construct, P26222-mTth007-S220-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggagagactaacggagttctctgggaccctattgttgctgtcgaaccggccggtaaggcgagaacattcgacttgcgcgttccaccctttgcaaacttcgtgagcgaggacctggtggtgcataactctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1882 - DNA, 1641 bp, Artificial Sequence
  Synthetic Construct, P26222-mTth001-S251-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggaactgatggagatgttctctgggaccctattgttgctgtcgaaccggccggtaaggcgagaacattcgacttgcgcgttccaccctttgcaaacttcgtgagcgaggacctggtggtgcataactcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1883 - DNA, 1641 bp, Artificial Sequence
  Synthetic Construct, P26222-mTth002-S251-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggaccagatcagaaggttctctgggaccctattgttgctgtcgaaccggccggtaaggcgagaacattcgacttgcgcgttccaccctttgcaaacttcgtgagcgaggacctggtggtgcataactcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1884 - DNA, 1641 bp, Artificial Sequence
  Synthetic Construct, P26222-mTth005-S251-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaagcagcgatggacttgttctctgggaccctattgttgctgtcgaaccggccggtaaggcgagaacattcgacttgcgcgttccaccctttgcaaacttcgtgagcgaggacctggtggtgcataactcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1885 - DNA, 1641 bp, Artificial Sequence
  Synthetic Construct, P26222-mTth007-S251-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggagagactaacggagttctctgggaccctattgttgctgtcgaaccggccggtaaggcgagaacattcgacttgcgcgttccaccctttgcaaacttcgtgagcgaggacctggtggtgcataactcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1886 - DNA, 1641 bp, Artificial Sequence
  Synthetic Construct, P26222-mTth008-S251-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccacaggagggagttggagttctctgggaccctattgttgctgtcgaaccggccggtaaggcgagaacattcgacttgcgcgttccaccctttgcaaacttcgtgagcgaggacctggtggtgcataactcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1887 - DNA, 1644 bp, Artificial Sequence
  Synthetic Construct, P26222-mTth010-S251-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctccagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgccttgaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1888 - DNA, 1641 bp, Artificial Sequence
  Synthetic Construct, P26222-mTth002-S123-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttccacctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcccaggaccagatcagaaggttctctgggaccctattgttgctgtcgaaccggccggtaaggcgagaacattcgacttgcgcgttccaccctttgcaaacttcgtgagcgaggacctggtggtgcataacagcgcttatcggtcttggatcgacgagtttgctgctggcctcaagaaccgtcccgcttacatcattgtggagcctgacctgataagccttatgtcgtcgtgtatgcagcacgttcaacaggaggtgctggagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctggaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1889 - DNA, 1644 bp, Artificial Sequence
  Synthetic Construct, P26222-mTth010-S115-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataacagttcgggtggggctccttcccacagcgcttatcggtcttggatcgacgagtttgctgctggcctcaagaaccgtcccgcttacatcattgtggagcctgacctgataagccttatgtcgtcgtgtatgcagcacgttcaacaggaggtgctggagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctggaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1890 - DNA, 1644 bp, Artificial Sequence
  Synthetic Construct, P26222-mTth010-S154-1 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctggagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctggaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1891 - DNA, 1641 bp, Artificial Sequence
  Synthetic Construct, P26222-mTth010-S154-2 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagtactcggtcagggagaacgctggtgttgacgccaaatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctggagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctggaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcg

SEQ ID NO: 1892 - DNA, 1644 bp, Artificial Sequence
  Synthetic Construct, P26222-mTth010-S154-3 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttatggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctggagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctggaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1893 - DNA, 1644 bp, Artificial Sequence
  Synthetic Construct, P26222-mTth010-S154-4 DNA
atgaacgatagtccattctacgtgaacccgaatatgtcatcagctgagtgggtgcgtaacaaccccaatgaccctcgcacaccagtcattagggatcgtattgcctcggtgccccaaggaacgtggttcgcccaccataaccctggccagattacagggcaagttgatgctctgatgtccgccgctcaagccgcgggtaagatccctattctcgtggtgtacaacgcaccaggacgcgactgcgggaatcatagttcgggtggggctccttcccacagcgcttatcggtcttggatcgacgagtttgctgctggcctcaagaaccgtcccgcttacatcattgtggagcctgacctgataagccttatgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacagcaaatcacccgctattgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcgtcgtgtatgcagcacgttcaacaggaggtgctggagactatggcctacgcagggaaggccttgaaggccggctcatcccaggcccgtatctatttcgacgcggggcattcggcgtggcattcaccagcgcagatggcttcttggctccagcaggctgatatctcaaactctgcacatggtatcgccacgaatacttctaactaccgttggaccgctgatgaagtcgcgtacgccaaggccgtgctgtccgccataggaaatccctccctcagagccgtcatagatacgtcccgcaacggaaatggccctgctggaaatgagtggtgcgacccaagcggacgcgctatcggaaccccgagtaccacaaatactggcgacccaatgatcgatgctttcctctggattaagcttccgggagaagcagacggttgcatcgccggagctggccaattcgttccacaagcagcatacgagatggctattgcggcgggtggtacgaatcctaatcccaaccccaaccctacgccaacgcccacaccgactcccactccacctccggggagcagcggcgcctgcacagccacctatacaatcgcaaacgaatggaatgatggcttccaagcgacggtgacggtgaccgcgaaccagaacatcactgggtggactgtcacttggactttcacggatggacagactattactaacgcctggaatgctgacgtttcgacgtcaggttcgtctgtgacggcgcgcaacgtcgggcataatggtactctctcccagggcgccagcacagagtttggctttgtcggctcaaagggaaattcaaatagcgtccccactctcacgtgcgccgcctcgtga

SEQ ID NO: 1894 - DNA, 1644 bp, Artificial Sequence; identical to SEQ ID NO: 1893
  Synthetic Construct, P26222-mTth010-S154-5 DNA

SEQ ID NO: 1895 - DNA, 2835 bp, Artificial Sequence
  Synthetic Construct, P54583-Tth-S56-1 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1896 - DNA, 1974 bp, Artificial Sequence
  Synthetic Construct, P54583-mTth010-S56-1 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1897 - DNA, 2835 bp, Artificial Sequence
  Synthetic Construct, P54583-Tth-C75-1 DNA
atggctggaggaggatactggcacacttccggcagggagatcctcgacgcaaataacgttccagtcagaatcgccgggattaattggtttggcttcgaaacgtgccttgccgagggtacccgagtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaaggggttgtcgtgcacaactgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1898 - DNA, 2835 bp, Artificial Sequence
  Synthetic Construct, P54583-Tth-S192-1 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1899 - DNA, 2835 bp, Artificial Sequence
  Synthetic Construct, P54583-Tth-S237-1 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1900 - DNA, 1974 bp, Artificial Sequence
  Synthetic Construct, P54583-mTth010-S237-1 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1901 - DNA, 1974 bp, Artificial Sequence
  Synthetic Construct, P54583-mTth010-S56-2 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgtcgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataattccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1902 - DNA, 1974 bp, Artificial Sequence
  Synthetic Construct, P54583-mTth010-S56-3 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccttattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1903 - DNA, 1974 bp, Artificial Sequence
  Synthetic Construct, P54583-mTth010-S56-4 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgtgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1904 - DNA, 1974 bp, Artificial Sequence
  Synthetic Construct, P54583-mTth010-S56-5 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgtgcctcagaactcggtcagggagaacgctggtgttgacaccagatcacccgcttttgacccccgaaggttggaagcctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1905 - DNA, 1974 bp, Artificial Sequence
  Synthetic Construct, P54583-mTth010-S56-6 DNA
atggctggaggaggatactggcacacttccggcagggagatcctcgacgcaaataacgtttcagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatgaaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1906 - DNA, 1974 bp, Artificial Sequence
  Synthetic Construct, P54583-mTth010-S56-7 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccggttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1907 - DNA, 1974 bp, Artificial Sequence
  Synthetic Construct, P54583-mTth010-S237-2 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttggcccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1908 - DNA, 1974 bp, Artificial Sequence
  Synthetic Construct, P54583-mTth010-S237-3 DNA
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgtcccccgaaggttggaaacctctttgtgacctcccgcttggaactccaattgcagtcagagatgttgagactggagaggttctctgggaccctattgttgctgtcgaaccggccggtaaggcgagaacattcgacttgcgcgttccaccctttgcaaacttcgtgagcgaggacctggtggtgcataactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1909 - DNA, 2568 bp, Artificial Sequence
  Synthetic Construct, O77044-Tth-S84-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1910 - DNA, 2568 bp, Artificial Sequence
  Synthetic Construct, O77044-Tth-T303-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1911 - DNA, 2568 bp, Artificial Sequence
  Synthetic Construct, O77044-Tth-S325-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1912 - DNA, 2568 bp, Artificial Sequence
  Synthetic Construct, O77044-Tth-T333-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1913 - DNA, 2568 bp, Artificial Sequence
  Synthetic Construct, O77044-Tth-S345-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1914 - DNA, 2568 bp, Artificial Sequence
  Synthetic Construct, O77044-Tth-C348-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1915 - DNA, 2568 bp, Artificial Sequence
  Synthetic Construct, O77044-Tth-S352-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1916 - DNA, 2568 bp, Artificial Sequence
  Synthetic Construct, O77044-Tth-T356-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1917 - DNA, 2568 bp, Artificial Sequence
  Synthetic Construct, O77044-Tth-S362-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1918 - DNA, 2568 bp, Artificial Sequence
  Synthetic Construct, O77044-Tth-S363-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1919 - DNA, 2568 bp, Artificial Sequence
  Synthetic Construct, O77044-Tth-S364-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1920 - DNA, 2568 bp, Artificial Sequence
  Synthetic Construct, O77044-Tth-T376-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaattgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1921 - DNA, 2568 bp, Artificial Sequence
  Synthetic Construct, O77044-Tth-S379-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 1922 - DNA, 2568 bp, Artificial Sequence
  Synthetic Construct, O77044-Tth-S406-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcagactatgttcacaacgaagtcgccactgattacaacgcgggtttccagtccgcgttagctgctttggtggcccttggttac

SEQ ID NO: 1923 - DNA, 2568 bp, Artificial Sequence
  Synthetic Construct, O77044-Tth-T415-1 DNA
tccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacactgattacaacgcgggtttccagtccgcgttagctgctttggtggcccttggttac

SEQ ID NO: 1924 - DNA, 585 bp, Artificial Sequence
  Synthetic Construct, EU591743
atggcccagacctgcctcacgtcgccccaaaccggctttcacaatggcttcttctattccttctggaaggacagtccgggcacggtgaatttttgcctgttggagggcggccgttacacatcgaactggagcggcatcaacaactgggtgggcggcaagggatggcagaccggttcacgccggaacatcacgtactcgggcagcttcaatacaccgggcaacggctacctggcgctttacggatggaccaccaatccactcgtcgagtactacgtcgtcgatagctgggggagctggcgtccgccgggttcggacggaacgttcctggggacggtcaacagcgatggcggaacgtatgacatctatcgcgcgcagcgggtcaacgcgccgtccatcatcggcaacgccacgttctatcaatactggagcgttcggcagtcgaagcgggtaggtgggacgatcaccaccggaaaccacttcgacgcgtgggccagcgtgggcctgaacctgggcactcacaactaccagatcatggcgaccgagggctaccaaagcagcggcagctccgacatcacggtgagttaa

SEQ ID NO: 1925 - protein, 512 aa, Clostridium stercorarium
  P33558
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITQWMAGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKSGT

SEQ ID NO: 1926 - protein, 413 aa, Erwinia chrysanthemi
  Q46961
MNGNVSLWVRHCLHAALFVSATAGSFSVYADTVKIDANVNYQIIQGFGGMSGVGWINDLTTEQINTAYGSGVGQIGLSIMRVRIDPDSSKWNIQLPSARQAVSLGAKIMATPWSPPAYMKSNNSLINGGRLLPANYSAYTSHLLDFSKYMQTNGAPLYAISIQNEPDWKPDYESCEWSGDEFKSYLKSQGSKFGSLKVIVAESLGFNPALTDPVLKDSDASKYVSIIGGHLYGTTPKPYPLAQNAGKQLWMTEHYVDSKQSANNWTSAIEVGTELNASMVSNYSAYVWWYIRRSYGLLTEDGKVSKRGYVMSQYARFVRPGALRIQATENPQSNVHLTAYKNTDGKMVIVAVNTNDSDQMLSLNISNANVTKFEKYSTSASLNVEYGGSSQVDSSGKATVWLNPLSVTTFVSK

SEQ ID NO: 1927 - protein, 346 aa, Thermotoga sp.
  Q60044
MKGLPALLLLLIGCVSSFGSQDVPLRVLAEKLNIHIGFAAGNNFWSLPDAEKYMEVAKREFNILTPENQMKWDTIHPERNRYNFEPAEKHVEFALKNDMIVHGHTLVWHNQLPGWLTGQEWSKEELLNILEDHVKTVVSHFRGRVKIWDVVNEAVSDSGTYRESIWYKTIGPEYIEKAFIWAREADPDAVLIYNDYSIEEINAKSNFVYNMIKNLKEKGVPIDGIGFQMHIDYRGLNYESFKKNLERFAELGLQIYITEMDVRIPLGGSEEYYLKKQAEVYRRIFEICLDNPAVRAIQFWGFTDKYSWVPGFFKGYGKALIFDENYNPKPCYFAIRELMEEKLKER

SEQ ID NO: 1928 - protein, 423 aa, Artificial Sequence
  Synthetic Construct, Tth-P71L
CLAEGSLVLDAATGQRVPIEKVRPGMEVFSLGPDYRLYRVPVLEVLESGVREVVRLRTRSGRTLVLTPDHLLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 1929 - protein, 423 aa, Artificial Sequence
  Synthetic Construct, Tth-P71T
CLAEGSLVLDAATGQRVPIEKVRPGMEVFSLGPDYRLYRVPVLEVLESGVREVVRLRTRSGRTLVLTPDHTLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 1930 - protein, 423 aa, Artificial Sequence
  Synthetic Construct, Tth-P71Q
CLAEGSLVLDAATGQRVPIEKVRPGMEVFSLGPDYRLYRVPVLEVLESGVREVVRLRTRSGRTLVLTPDHQLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 1931 - protein, 784 aa, Artificial Sequence; identical to SEQ ID NO: 1630
  Synthetic Construct, P77853_P136ins-Tth-T134

SEQ ID NO: 1932 - protein, 784 aa, Artificial Sequence; identical to SEQ ID NO: 1634
  Synthetic Construct, P77853_S135V_P136ins-Tth-T134

SEQ ID NO: 1933 - DNA, 1566 bp, Artificial Sequence
  Synthetic Construct, P54583_opt
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctca

SEQ ID NO: 1934 - DNA, 25 bp, Artificial Sequence
  Synthetic Construct, P54583-Tth Primer A
gctgttttgccattttccaacagca

SEQ ID NO: 1935 - DNA, 40 bp, Artificial Sequence
  Synthetic Construct, P54583-Tth Primer C
tgcctggccgagggctcgctcgtcttggacgcggctaccg

SEQ ID NO: 1936 - DNA, 40 bp, Artificial Sequence
  Synthetic Construct, P54583-Tth Primer D
gttatgcaccaccaggtcctcgctcacgaagtttgcaaag

SEQ ID NO: 1937 - DNA, 23 bp, Artificial Sequence
  Synthetic Construct, P54583-Tth Primer F
cccaaaaccttctcaagcaaggt

SEQ ID NO: 1938 - DNA, 40 bp, Artificial Sequence
  Synthetic Construct, P54583-Tth-S10 Primer B
agcgagccctcggccaggcaagtgtgccagtatcctcctc

SEQ ID NO: 1939 - DNA, 40 bp, Artificial Sequence
  Synthetic Construct, P54583-Tth-S56 Primer B
agcgagccctcggccaggcatttgatctggtcgagcattg

SEQ ID NO: 1940 - DNA, 39 bp, Artificial Sequence
  Synthetic Construct, P54583-Tth-C75 Primer B
tcgggtaccctcggcaaggcacgtttcgaagccaaacca

SEQ ID NO: 1941 - DNA, 40 bp, Artificial Sequence
  Synthetic Construct, P54583-Tth-T61-1 Primer B
agcgagccctcggccaggcaattataccccaaggatttga

SEQ ID NO: 1942 - DNA, 40 bp, Artificial Sequence
  Synthetic Construct, P54583-Tth-T67 Primer B
agcgagccctcggccaggcagtagggcagcctaattgtat

SEQ ID NO: 1943 - DNA, 40 bp, Artificial Sequence
  Synthetic Construct, P54583-Tth-T93 Primer B
agcgagccctcggccaggcacaatccctgcagatcctggt

SEQ ID NO: 1944 - DNA, 40 bp, Artificial Sequence
  Synthetic Construct, P54583-Tth-S94 Primer B
agcgagccctcggccaggcaagtcaatccctgcagatcct

SEQ ID NO: 1945 - DNA, 40 bp, Artificial Sequence
  Synthetic Construct, P54583-Tth-S134 Primer B
agcgagccctcggccaggcacacggagcttgtgtaccaca

SEQ ID NO: 1946 - DNA, 40 bp, Artificial Sequence
  Synthetic Construct, P54583-Tth-T154 Primer B
agcgagccctcggccaggcaggggttgcctttatagcgtt

SEQ ID NO: 1947 - DNA, 40 bp, Artificial Sequence
  Synthetic Construct, P54583-Tth-S192 Primer B
agcgagccctcggccaggcagagaacggcgttaccagccc

SEQ ID NO: 1948 - DNA, 40 bp, Artificial Sequence
  Synthetic Construct, P54583-Tth-S237 Primer B
agcgagccctcggccaggcagtagaccaggcgattcggaa

SEQ ID NO: 1949 - DNA, 40 bp, Artificial Sequence
  Synthetic Construct, P54583-Tth-S290 Primer B
agcgagccctcggccaggcactgaagagtggtgccaaatt

SEQ ID NO: 1950 - DNA, 40 bp, Artificial Sequence
  Synthetic Construct, P54583-Tth-S314 Primer B
agcgagccctcggccaggcaatctgctccgtactgagcag

SEQ ID NO: 1951 - DNA, 40 bp, Artificial Sequence
  Synthetic Construct, P54583-Tth-S321 Primer B
agcgagccctcggccaggcaccagaacgtccattgaaaag

SEQ ID NO: 1952 - DNA, 40 bp, Artificial Sequence
  Synthetic Construct, P54583-Tth-S353 Primer B
agcgagccctcggccaggcatttaatcggcgccaagtacc

SEQ ID NO: 1953 - DNA, 40 bp, Artificial Sequence
  Synthetic Construct, P54583-Tth-S10 Primer E
aggacctggtggtgcataactccggcagggagatcctcga

SEQ ID NO: 1954 - DNA, 40 bp, Artificial Sequence
  Synthetic Construct, P54583-Tth-S56 Primer E
aggacctggtggtgcataactccttggggtataatacaat

SEQ ID NO: 1955 - DNA, 42 bp, Artificial Sequence
  Synthetic Construct, P54583-Tth-C75 Primer E
aggggttgtcgtgcacaactgtaactacgtggttcacggcct

SEQ ID NO: 1956 - DNA, 40 bp, Artificial Sequence
  Synthetic Construct, P54583-Tth-T61 Primer E
aggacctggtggtgcataacacaattaggctgccctacag

SEQ ID NO: 1957 - DNA, 40 bp, Artificial Sequence
  Synthetic Construct, P54583-Tth-S67 Primer E
aggacctggtggtgcataacagcgatgacattcttaagcc

SEQ ID NO: 1958 - DNA, 40 bp, Artificial Sequence
  Synthetic Construct, P54583-Tth-T93 Primer E
aggacctggtggtgcataacacttctctgcaggttatgga

SEQ ID NO: 1959 - DNA, 40 bp, Artificial Sequence
  Synthetic Construct, P54583-Tth-S94 Primer E
aggacctggtggtgcataactctctgcaggttatggacaa

SEQ ID NO: 1960 - DNA, 40 bp, Artificial Sequence
  Synthetic Construct, P54583-Tth-S134 Primer E
aggacctggtggtgcataactcagaggcaacatggatttc

SEQ ID NO: 1961 - DNA, 40 bp, Artificial Sequence
  Synthetic Construct, P54583-Tth-T154 Primer E
aggacctggtggtgcataacacggttgtgggattcgacct

SEQ ID NO: 1962 - DNA, 40 bp, Artificial Sequence
  Synthetic Construct, P54583-Tth-S192 Primer E
aggacctggtggtgcataacagcgtcaatcccaacttgct

SEQ ID NO: 1963 - DNA, 40 bp, Artificial Sequence
  Synthetic Construct, P54583-Tth-S237 Primer E
aggacctggtggtgcataactcagcacacgactacgcgac

SEQ ID NO: 1964 - DNA, 40 bp, Artificial Sequence
  Synthetic Construct, P54583-Tth-S290 Primer E
aggacctggtggtgcataactcgacgacagaccaaacctg

SEQ ID NO: 1965 - DNA, 40 bp, Artificial Sequence
  Synthetic Construct, P54583-Tth-S314 Primer E
aggacctggtggtgcataactcttttcaatggacgttctg

SEQ ID NO: 1966 - DNA, 40 bp, Artificial Sequence
  Synthetic Construct, P54583-Tth-S321 Primer E
aggacctggtggtgcataactcttggaatcctgactccgg

SEQ ID NO: 1967 - DNA, 40 bp, Artificial Sequence
  Synthetic Construct, P54583-Tth-S353 Primer E
aggacctggtggtgcataacagctcgatctttgacccagt

SEQ ID NO: 1968 - DNA, 44 bp, Artificial Sequence
  Synthetic Construct, P54583-Tth-C75Tth Primer C alternative
tgccttgccgagggtacccgagtcttggacgcggctaccgggca

SEQ ID NO: 1969 - DNA, 43 bp, Artificial Sequence
  Synthetic Construct, P54583-Tth-C75Tth Primer D alternative
gttgtgcacgacaaccccttcgctcacgaagtttgcaaagggt

SEQ ID NO: 1970 - DNA, 25 bp, Artificial Sequence
  Synthetic Construct, P54583-Psp-pol Primer A
gctgttttgccattttccaacagca

SEQ ID NO: 1971 - DNA, 23 bp, Artificial Sequence
  Synthetic Construct, P54583-Psp-pol Primer C
agcattttaccggaagaatgggt

SEQ ID NO: 1972 - DNA, 22 bp, Artificial Sequence
  Synthetic Construct, P54583-Psp-pol Primer D
attatgtgcatagaggaatcca

SEQ ID NO: 1973 - DNA, 23 bp, Artificial Sequence
  Synthetic Construct, P54583-Psp-pol Primer F
cccaaaaccttctcaagcaaggt

SEQ ID NO: 1974 - DNA, 41 bp, Artificial Sequence
  Synthetic Construct, P54583-Psp-pol-C75 Primer B
acccattcttccggtaaaatgctcgtttcgaagccaaacca

SEQ ID NO: 1975 - DNA, 44 bp, Artificial Sequence
  Synthetic Construct, P54583-Psp-pol-S56 Primer B
acccattcttccggtaaaatgcttttgatctggtcgagcattga

SEQ ID NO: 1976 - DNA, 43 bp, Artificial Sequence
  Synthetic Construct, P54583-Psp-pol-S94 Primer B
acccattcttccggtaaaatgctagtcaatccctgcagatcct

SEQ ID NO: 1977 - DNA, 42 bp, Artificial Sequence
  Synthetic Construct, P54583-Psp-pol-S237 Primer B
acccattcttccggtaaaatgctgtagaccaggcgattcgga

SEQ ID NO: 1978 - DNA, 45 bp, Artificial Sequence
  Synthetic Construct, P54583-Psp-pol-S290 Primer B
acccattcttccggtaaaatgctctgaagagtggtgccaaattca

SEQ ID NO: 1979 - DNA, 46 bp, Artificial Sequence
  Synthetic Construct, P54583-Psp-pol-S353 Primer B
acccattcttccggtaaaatgcttttaatcggcgccaagtacccgt

SEQ ID NO: 1980 - DNA, 44 bp, Artificial Sequence
  Synthetic Construct, P54583-Psp-pol-C465 Primer B
acccattcttccggtaaaatgctcctagccccgctcgctgcggt

SEQ ID NO: 1981 - DNA, 45 bp, Artificial Sequence
  Synthetic Construct, P54583-Psp-pol-C75 Primer E
tggattcctctatgcacataattgtaactacgtggttcacggcct

SEQ ID NO: 1982 - DNA, 48 bp, Artificial Sequence
  Synthetic Construct, P54583-Psp-pol-S56 Primer E
tggattcctctatgcacataattccttggggtataatacaattaggct

SEQ ID NO: 1983 - DNA, 48 bp, Artificial Sequence
  Synthetic Construct, P54583-Psp-pol-S94 Primer E
tggattcctctatgcacataattctctgcaggttatggacaagatcgt

SEQ ID NO: 1984 - DNA, 41 bp, Artificial Sequence
  Synthetic Construct, P54583-Psp-pol-S237 Primer E
tggattcctctatgcacataattcagcacacgactacgcga

SEQ ID NO: 1985 - DNA, 41 bp, Artificial Sequence
  Synthetic Construct, P54583-Psp-pol-S290 Primer E
tggattcctctatgcacataattcgacgacagaccaaacct

SEQ ID NO: 1986 - DNA, 42 bp, Artificial Sequence
  Synthetic Construct, P54583-Psp-pol-S353 Primer E
tggattcctctatgcacataatagctcgatctttgacccagt

SEQ ID NO: 1987 - DNA, 42 bp, Artificial Sequence
  Synthetic Construct, P54583-Psp-pol-C465 Primer E
tggattcctctatgcacataattgcaccgcttcttaccaggt

SEQ ID NO: 1988 - DNA, 25 bp, Artificial Sequence
  Synthetic Construct, P54583-RecA Primer A
gctgttttgccattttccaacagca

SEQ ID NO: 1989 - DNA, 29 bp, Artificial Sequence
  Synthetic Construct, P54583-RecA Primer C
tgccttgccgagggtacccgaatcttcga

SEQ ID NO: 1990 - DNA, 26 bp, Artificial Sequence
  Synthetic Construct, P54583-RecA Primer D
gttgtgcacgacaaccccttcggcga

SEQ ID NO: 1991 - DNA, 23 bp, Artificial Sequence
  Synthetic Construct, P54583-RecA Primer F
cccaaaaccttctcaagcaaggt

SEQ ID NO: 1992 - DNA, 39 bp, Artificial Sequence; identical to SEQ ID NO: 1940
  Synthetic Construct, P54583-RecA-C75 Primer B

SEQ ID NO: 1993 - DNA, 42 bp, Artificial Sequence
  Synthetic Construct, P54583-RecA-S56 Primer B
tcgggtaccctcggcaaggcatttcatctggtcgagcattga

SEQ ID NO: 1994 - DNA, 41 bp, Artificial Sequence
  Synthetic Construct, P54583-RecA-S94 Primer B
tcgggtaccctcggcaaggcaagtcaatccctgcagatcct

SEQ ID NO: 1995 - DNA, 40 bp, Artificial Sequence
  Synthetic Construct, P54583-RecA-S237 Primer B
tcgggtaccctcggcaaggcagtagaccaggcgattcgga

SEQ ID NO: 1996 - DNA, 43 bp, Artificial Sequence
  Synthetic Construct, P54583-RecA-S290 Primer B
tcgggtaccctcggcaaggcactgaagagtggtgccaaattca

SEQ ID NO: 1997 - DNA, 44 bp, Artificial Sequence
  Synthetic Construct, P54583-RecA-S353 Primer B
tcgggtaccctcggcaaggcatttaatcggcgccaagtacccgt

SEQ ID NO: 1998 - DNA, 42 bp, Artificial Sequence
  Synthetic Construct, P54583-RecA-C465 Primer B
tcgggtaccctcggcaaggcacctagccccgctcgctgcggt

SEQ ID NO: 1999 - DNA, 42 bp, Artificial Sequence; identical to SEQ ID NO: 1955
  Synthetic Construct, P54583-RecA-C75 Primer E

SEQ ID NO: 2000 - DNA, 45 bp, Artificial Sequence
  Synthetic Construct, P54583-RecA-S56 Primer E
aggggttgtcgtgcacaactccttggggtataatacaattaggct

SEQ ID NO: 2001 - DNA, 45 bp, Artificial Sequence
  Synthetic Construct, P54583-RecA-S94 Primer E
aggggttgtcgtgcacaactctctgcaggttatggacaagatcgt

SEQ ID NO: 2002 - DNA, 38 bp, Artificial Sequence
  Synthetic Construct, P54583-RecA-S237 Primer E
aggggttgtcgtgcacaactcagcacacgactacgcga

SEQ ID NO: 2003 - DNA, 38 bp, Artificial Sequence
  Synthetic Construct, P54583-RecA-S290 Primer E
aggggttgtcgtgcacaactcgacgacagaccaaacct

SEQ ID NO: 2004 - DNA, 39 bp, Artificial Sequence
  Synthetic Construct, P54583-RecA-S353 Primer E
aggggttgtcgtgcacaacagctcgatctttgacccagt

SEQ ID NO: 2005 - DNA, 40 bp, Artificial Sequence
  Synthetic Construct, P54583-RecA-C465 Primer E
aggggttgtcgtgcacaactgcaccgctttcttaccaggt

SEQ ID NO: 2006 - DNA, 6680 bp, Artificial Sequence
  Synthetic Construct, pAL410
taaggcgcgcctttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatttcgaaacgatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagagaggctgaagctgaattcacgtggcccagccggccgtctcggatcggtacctcgagccgcggcggccgccagctttctagaacaaaaactcatctcagaagaggatctgaatagcgccgtcgaccatcatcatcatcatcattgattaattaacatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagtttctggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggccttggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccag

SEQ ID NO: 2007 - DNA, 164 bp, Artificial Sequence
  Synthetic Construct, Truncated Tth
tgcctggccgagggctcgctcgtcttggacgcggctaccgggcagagggtccctatcgaaaaggtgcgtccggggatatcgaaccggccggtaaggcgagaacattcgacttgcgcgttccaccctttgcaaacttcgtgagcgaggacctggtggtgcataac

SEQ ID NO: 2008 - protein, 408 aa, Artificial Sequence
  Synthetic Construct, mTth010_DNA
TGCCTGGCCGAGGGCTCGCTCGTCTTGGACGCGGCTACCGGGCAGAGGGTCCCTATCGAAAAGGTGCGTCCGGGGATGGAAGTTTTCTCCTTGGGACCTGATTACAGACTGTATCGGGTGCCCGTTTTGGAGGTCCTTGAGAGCGGGGTTAGGGAAGTTGTGCGCCTCAGAACTCGGTCAGGGAGAACGCTGGTGTTGACACCAGATCACCCGCTTTTGACCCCCGAAGGTTGGAAACCTCTTTGTGACCTCCCGCTTGGAACTCCAATTGCAGTCAGAGATGTTGAGACTGGAGAGGTTCTCTGGGACCCTATTGTTGCTGTCGAACCGGCCGGTAAGGCGAGAACATTCGACTTGCGCGTTCCACCCTTTGCAAACTTCGTGAGCGAGGACCTGGTGGTGCATAAC

SEQ ID NO: 2009 - protein, 657 aa, Artificial Sequence
  Synthetic Construct, P54583-mTth001-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGTDGDVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2010 - protein, 657 aa, Artificial Sequence
  Synthetic Construct, P54583-mTth002-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGPDQKVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2011 - protein, 657 aa, Artificial Sequence
  Synthetic Construct, P54583-mTth003-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPEPGKGVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2012 - protein, 657 aa, Artificial Sequence
  Synthetic Construct, P54583-mTth004-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPDSEGNVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2013 - protein, 657 aa, Artificial Sequence
  Synthetic Construct, P54583-mTth005-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPSSDGLVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2014 - protein, 657 aa, Artificial Sequence
  Synthetic Construct, P54583-mTth007-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPGETNGVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2015 - protein, 657 aa, Artificial Sequence
  Synthetic Construct, P54583-mTth008-S237
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPQEGVGVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2016 - protein, 658 aa, Artificial Sequence; identical to SEQ ID NO: 1744
  Synthetic Construct, P54583-mTth010-S237

SEQ ID NO: 2017 - DNA, 1344 bp, Artificial Sequence
  Synthetic Construct, O77044_opt
atgagggtgttcctttgcctgctctcggcgctagctttgtgccaggcggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttac

SEQ ID NO: 2018 - DNA, 25 bp, Artificial Sequence
  Synthetic Construct, O77044-Tth Primer A
gctgttttgccattttccaacagca

SEQ ID NO: 2019 - DNA, 40 bp, Artificial Sequence; identical to SEQ ID NO: 1935
  Synthetic Construct, O77044-Tth Primer C

SEQ ID NO: 2020 - DNA, 40 bp, Artificial Sequence; identical to SEQ ID NO: 1936
  Synthetic Construct, O77044-Tth Primer D

SEQ ID NO: 2021 - DNA, 23 bp, Artificial Sequence
  Synthetic Construct, O77044-Tth Primer F
cccaaaaccttctcaagcaaggt

SEQ ID NO: 2022 - DNA, 52 bp, Artificial Sequence
  Synthetic Construct, O77044-Tth-S84 Primer B
tccaagacgagcgagccctcggccaggcagtagccggcctcaaaatctatga

SEQ ID NO: 2023 - DNA, 52 bp, Artificial Sequence
  Synthetic Construct, O77044-Tth-T303 Primer B
tccaagacgagcgagccctcggccaggcagccccacatgtcgatgtagagga

SEQ ID NO: 2024 - DNA, 46 bp, Artificial Sequence
  Synthetic Construct, O77044-Tth-S325 Primer B
tccaagacgagcgagccctcggccaggcaggcggacaagcccagct

SEQ ID NO: 2025 - DNA, 53 bp, Artificial Sequence
  Synthetic Construct, O77044-Tth-T333 Primer B
tccaagacgagcgagccctcggccaggcattgcgcgaactgtctataagagga

SEQ ID NO: 2026 - DNA, 46 bp, Artificial Sequence
  Synthetic Construct, O77044-Tth-S345 Primer B
tccaagacgagcgagccctcggccaggcagcggccaccatcgccca

SEQ ID NO: 2027 - DNA, 48 bp, Artificial Sequence
  Synthetic Construct, O77044-Tth-C348 Primer B
tccaagacgagcgagccctcggccaggcacacaaaggagcggccacca

SEQ ID NO: 2028 - DNA, 45 bp, Artificial Sequence
  Synthetic Construct, O77044-Tth-S352 Primer B
tccaagacgagcgagccctcggccaggcacccgaacccgcacaca

SEQ ID NO: 2029 - DNA, 46 bp, Artificial Sequence
  Synthetic Construct, O77044-Tth-T356 Primer B
tccaagacgagcgagccctcggccaggcaaggaggattactcccga

SEQ ID NO: 2030 - DNA, 47 bp, Artificial Sequence
  Synthetic Construct, O77044-Tth-S362 Primer B
tccaagacgagcgagccctcggccaggcatctgtggtgcggtctcgt

SEQ ID NO: 2031 - DNA, 50 bp, Artificial Sequence
  Synthetic Construct, O77044-Tth-S363 Primer B
tccaagacgagcgagccctcggccaggcaggatctgtggtgcggtctcgt

SEQ ID NO: 2032 - DNA, 48 bp, Artificial Sequence
  Synthetic Construct, O77044-Tth-S364 Primer B
tccaagacgagcgagccctcggccaggcacgaggatctgtggtgcggt

SEQ ID NO: 2033 - DNA, 51 bp, Artificial Sequence
  Synthetic Construct, O77044-Tth-T376 Primer B
tccaagacgagcgagccctcggccaggcaattccagtcgcaagtagcggga

SEQ ID NO: 2034 - DNA, 50 bp, Artificial Sequence
  Synthetic Construct, O77044-Tth-S379 Primer B
tccaagacgagcgagccctcggccaggcagttgaatgtattccagtcgca

SEQ ID NO: 2035 - DNA, 51 bp, Artificial Sequence
  Synthetic Construct, O77044-Tth-S406 Primer B
tccaagacgagcgagccctcggccaggcaacggtcatcgacgtagttgtca

SEQ ID NO: 2036 - DNA, 48 bp, Artificial Sequence
  Synthetic Construct, O77044-Tth-T415 Primer B
tccaagacgagcgagccctcggccaggcaggcgacttcgttgtgaaca

SEQ ID NO: 2037 - DNA, 40 bp, Artificial Sequence
  Synthetic Construct, O77044-Tth-S84 Primer E
aggacctggtggtgcataacagcagtgccggggccttgga

SEQ ID NO: 2038 - DNA, 39 bp, Artificial Sequence
  Synthetic Construct, O77044-Tth-T303 Primer E
aggacctggtggtgcataacacccttcgccacgctgcca

SEQ ID NO: 2039 - DNA, 49 bp, Artificial Sequence
  Synthetic Construct, O77044-Tth-S325 Primer E
aggacctggtggtgcataactcctcttatagacagttcgcgcaaacgca

SEQ ID NO: 2040 - DNA, 40 bp, Artificial Sequence
  Synthetic Construct, O77044-Tth-T333 Primer E
aggacctggtggtgcataacacgcaaatcgactacgccct

SEQ ID NO: 2041 - DNA, 42 bp, Artificial Sequence
  Synthetic Construct, O77044-Tth-S345 Primer E
aggacctggtggtgcataactcctttgtgtgcgggttcggga

SEQ ID NO: 2042 - DNA, 41 bp, Artificial Sequence
  Synthetic Construct, O77044-Tth-C348 Primer E
aggacctggtggtgcataactgcgggttcgggagtaatcct

SEQ ID NO: 2043 - DNA, 43 bp, Artificial Sequence
  Synthetic Construct, O77044-Tth-S352 Primer E
aggacctggtggtgcataacagtaatcctcctacgagaccgca

SEQ ID NO: 2044 - DNA, 42 bp, Artificial Sequence
  Synthetic Construct, O77044-Tth-T356 Primer E
aggacctggtggtgcataacacgagaccgcaccacagatcct

SEQ ID NO: 2045 - DNA, 38 bp, Artificial Sequence
  Synthetic Construct, O77044-Tth-S362 Primer E
aggacctggtggtgcataactcctcgtcgtgcccgcca

SEQ ID NO: 2046 - DNA, 38 bp, Artificial Sequence
  Synthetic Construct, O77044-Tth-S363 Primer E
aggacctggtggtgcataactcgtcgtgcccgccagct

SEQ ID NO: 2047 - DNA, 41 bp, Artificial Sequence
  Synthetic Construct, O77044-Tth-S364 Primer E
aggacctggtggtgcataactcgtgcccgccagctcccgct

SEQ ID NO: 2048 - DNA, 41 bp, Artificial Sequence
  Synthetic Construct, O77044-Tth-T376 Primer E
aggacctggtggtgcataacacattcaactcacctgaccca

SEQ ID NO: 2049 - DNA, 40 bp, Artificial Sequence
  Synthetic Construct, O77044-Tth-S379 Primer E
aggacctggtggtgcataactcacctgacccaaactacca

SEQ ID NO: 2050 - DNA, 40 bp, Artificial Sequence
  Synthetic Construct, O77044-Tth-S406 Primer E
aggacctggtggtgcataactcagactatgttcacaacga

SEQ ID NO: 2051 - DNA, 43 bp, Artificial Sequence
  Synthetic Construct, O77044-Tth-T415 Primer E
aggacctggtggtgcataacactgattacaacgcgggtttcca

SEQ ID NO: 2052 - DNA, 2694 bp, Artificial Sequence; identical to SEQ ID NO: 1848
  Synthetic Construct, P77853-PspPol-S63 DNA

SEQ ID NO: 2053 - DNA, 2694 bp, Artificial Sequence; identical to SEQ ID NO: 1849
  Synthetic Construct, P77853-PspPol-S67 DNA

SEQ ID NO: 2054 - DNA, 2694 bp, Artificial Sequence; identical to SEQ ID NO: 1850
  Synthetic Construct, P77853-PspPol-S86 DNA

SEQ ID NO: 2055 - DNA, 2694 bp, Artificial Sequence; identical to SEQ ID NO: 1851
  Synthetic Construct, P77853-PspPol-S95 DNA

SEQ ID NO: 2056 - DNA, 2694 bp, Artificial Sequence; identical to SEQ ID NO: 1852
  Synthetic Construct, P77853-PspPol-S112 DNA

SEQ ID NO: 2057 - DNA, 2694 bp, Artificial Sequence; identical to SEQ ID NO: 1853
  Synthetic Construct, P77853-PspPol-S124 DNA

SEQ ID NO: 2058 - DNA, 2694 bp, Artificial Sequence; identical to SEQ ID NO: 1854
  Synthetic Construct, P77853-PspPol-S178 DNA

SEQ ID NO: 2059 - protein, 658 aa, Artificial Sequence; identical to SEQ ID NO: 1744
  NIC P54583 S237Tth139

SEQ ID NO: 2060 - protein, 658 aa, Artificial Sequence
  Synthetic Construct, P54583-mTth010-S237-4
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTVIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2061 - protein, 658 aa, Artificial Sequence
  Synthetic Construct, P54583-mTth010-S237-5
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPIGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2062 - protein, 658 aa, Artificial Sequence
  Synthetic Construct, P54583-mTth010-S237-6
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDRPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2063 - protein, 658 aa, Artificial Sequence
  Synthetic Construct, P54583-mTth010-S237-19
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQAIAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLVTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2064 - protein, 658 aa, Artificial Sequence
  Synthetic Construct, P54583-mTth010-S237-24
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKRRTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2065 - protein, 658 aa, Artificial Sequence
  Synthetic Construct, P54583-mTth010-S237-33
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEVAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2066 - protein, 658 aa, Artificial Sequence
  Synthetic Construct, P54583-mTth010-S237-42
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRAVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2067 - protein, 658 aa, Artificial Sequence
  Synthetic Construct, P54583-mTth010-S237-43
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPKRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2068 - protein, 658 aa, Artificial Sequence
  Synthetic Construct, P54583-mTth010-S237-44
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGKVLYDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2069 - protein, 658 aa, Artificial Sequence; identical to SEQ ID NO: 2067
  Synthetic Construct, P54583-mTth010-S237-45

SEQ ID NO: 2070 - protein, 658 aa, Artificial Sequence
  Synthetic Construct, P54583-mTth010-S237-46
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLSYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2071 - protein, 658 aa, Artificial Sequence
  Synthetic Construct, P54583-mTth010-S237-47
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNGLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2072 - protein, 658 aa, Artificial Sequence
  Synthetic Construct, P54583-mTth010-S237-48
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVRWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2073 - protein, 658 aa, Artificial Sequence; identical to SEQ ID NO: 2067
  Synthetic Construct, P54583-mTth010-S237-49

SEQ ID NO: 2074 - protein, 658 aa, Artificial Sequence
  Synthetic Construct, P54583-mTth010-S237-50
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPCRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2075 - protein, 658 aa, Artificial Sequence
  Synthetic Construct, P54583-mTth010-S237-51
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPLRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2076 - protein, 658 aa, Artificial Sequence
  Synthetic Construct, P54583-mTth010-S237-52
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRGVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2077 - protein, 658 aa, Artificial Sequence
  Synthetic Construct, P54583-mTth010-S237-53
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPSRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2078 - protein, 658 aa, Artificial Sequence
  Synthetic Construct, P54583-mTth010-S237-54
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPWRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2079 - protein, 658 aa, Artificial Sequence
  Synthetic Construct, P54583-mTth010-S237-55
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNLLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2080 - protein, 658 aa, Artificial Sequence
  Synthetic Construct, P54583-mTth010-S237-56
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPVRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2081 - protein, 658 aa, Artificial Sequence
  Synthetic Construct, P54583-mTth010-S237-57
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNSLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2082 - protein, 658 aa, Artificial Sequence
  Synthetic Construct, P54583-mTth010-S237-58
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPMRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2083 - protein, 658 aa, Artificial Sequence
  Synthetic Construct, P54583-mTth010-S237-59
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPARLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2084 - protein, 658 aa, Artificial Sequence; identical to SEQ ID NO: 2080
  Synthetic Construct, P54583-mTth010-S237-60

SEQ ID NO: 2085 - protein, 658 aa, Artificial Sequence
  Synthetic Construct, P54583-mTth010-S237-61
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVMWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2086 - protein, 658 aa, Artificial Sequence; identical to SEQ ID NO: 2077
  Synthetic Construct, P54583-mTth010-S237-62

SEQ ID NO: 2087 - protein, 658 aa, Artificial Sequence
  Synthetic Construct, P54583-mTth010-S237-63
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLGYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWDPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACVAS

SEQ ID NO: 2088 - protein, 658 aa, Artificial Sequence
  Synthetic Construct, P54583-mTth010-S237-64
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYCLAEGSLVLDAATGQRVPIEKVRPGMEVFSLGPDYRLYRVPVLEVLESGVREVVRLRTRSGRTLVLTPDHPLLTPEGWKPLCDLPLGTPIAVRDVETGEVLWVPIVAVEPAGKARTFDLRVPPFANFVSEDLVVHNSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 2089 - protein, 658 aa, Artificial Sequence; identical to SEQ ID NO: 2063
  Synthetic Construct, P54583-mTth010-S237-66

What is claimed is:

1. An intein modified protein comprising an amino acid sequence selected from the group consisting of SEQ ID NOS: 2060-2089.

2. A nucleic acid having a nucleotide sequence encoding an intein modified protein comprising an amino acid sequence selected from the group consisting of SEQ ID NOS: 2060-2089.

3. A transgenic plant comprising an intein-modified protein comprising an amino acid sequence selected from the group consisting of SEQ ID NOS: 2060-2089.

4. A transgenic plant comprising a nucleic acid having a nucleotide sequence encoding an intein modified protein comprising an amino acid sequence selected from the group consisting of SEQ ID NOS: 2060-2089.

5. The transgenic plant of claim 4 further comprising an expression construct, wherein the nucleic acid is contained within the expression construct.

* * * * *